(12) United States Patent
Bernal-Mizrachi et al.

(10) Patent No.: US 12,453,740 B2
(45) Date of Patent: Oct. 28, 2025

(54) NUCLEIC ACIDS FOR CELL RECOGNITION AND INTEGRATION

(71) Applicants: Emory University, Atlanta, GA (US); Kodikaz Therapeutic Solutions, Inc., New York, NY (US)

(72) Inventors: Leon Bernal-Mizrachi, Atlanta, GA (US); Matthew Charles Tindall, Piedmont, CA (US)

(73) Assignees: EMORY UNIVERSITY, Atlanta, GA (US); KODIKAZ THERAPEUTIC SOLUTIONS, INC., New York, NY (US)

( * ) Notice: Subject to any disclaimer, the term of this patent is extended or adjusted under 35 U.S.C. 154(b) by 923 days.

(21) Appl. No.: 17/211,622

(22) Filed: Mar. 24, 2021

(65) Prior Publication Data

US 2021/0315916 A1    Oct. 14, 2021

Related U.S. Application Data

(63) Continuation of application No. PCT/US2019/052680, filed on Sep. 24, 2019.

(60) Provisional application No. 62/875,887, filed on Jul. 18, 2019, provisional application No. 62/736,323, filed on Sep. 25, 2018.

(51) Int. Cl.
| | |
|---|---|
| A61K 48/00 | (2006.01) |
| A61K 31/711 | (2006.01) |
| A61K 45/06 | (2006.01) |
| A61K 51/02 | (2006.01) |

(52) U.S. Cl.
CPC ............ *A61K 31/711* (2013.01); *A61K 45/06* (2013.01); *A61K 48/0058* (2013.01); *A61K 51/02* (2013.01); *C12N 2800/90* (2013.01)

(58) Field of Classification Search
None
See application file for complete search history.

(56) References Cited

U.S. PATENT DOCUMENTS

| 10,233,495 B2 | 3/2019 | Hatchwell et al. |
|---|---|---|
| 2002/0198371 A1 | 12/2002 | Wang |
| 2003/0224356 A1 | 12/2003 | Knoll et al. |
| 2005/0228172 A9 | 10/2005 | Wang |
| 2006/0057564 A1 | 3/2006 | Wang |
| 2006/0194210 A1 | 8/2006 | Morris et al. |
| 2007/0054278 A1 | 3/2007 | Cargill |
| 2007/0161031 A1 | 7/2007 | Trinklein et al. |
| 2008/0008687 A1 | 1/2008 | Ivics et al. |
| 2009/0270332 A1 | 10/2009 | Bare et al. |
| 2010/0298170 A1 | 11/2010 | Heredia et al. |
| 2013/0123478 A1 | 5/2013 | Levy et al. |
| 2013/0281423 A1 | 10/2013 | Singh et al. |
| 2014/0010861 A1 | 1/2014 | Bancel et al. |
| 2014/0161721 A1 | 6/2014 | Hatchwell et al. |
| 2015/0252368 A1 | 9/2015 | Tonon et al. |
| 2019/0309291 A1 | 10/2019 | Lee et al. |
| 2019/0314398 A1 | 10/2019 | Simone et al. |
| 2020/0270307 A1 | 8/2020 | Del'Guidice et al. |
| 2021/0100905 A1 | 4/2021 | Jiang et al. |
| 2021/0254056 A1 | 8/2021 | Liu et al. |
| 2022/0049255 A1 | 2/2022 | Lee et al. |
| 2022/0090207 A1 | 3/2022 | Venn et al. |
| 2022/0119817 A1 | 4/2022 | Lee et al. |

FOREIGN PATENT DOCUMENTS

| CN | 103501818 A | 1/2014 |
|---|---|---|
| CN | 107847554 A | 3/2018 |
| WO | WO-0220822 A2 | 3/2002 |
| WO | WO-2005087949 A1 | 9/2005 |
| WO | WO-2012095527 A1 | 7/2012 |
| WO | WO-2017046259 A1 | 3/2017 |
| WO | WO-2020068815 A1 | 4/2020 |
| WO | WO-2023107964 A1 | 6/2023 |
| WO | WO-2024026466 A2 | 2/2024 |

OTHER PUBLICATIONS

Kong, et al. Transposable element expression in tumors is associated with immune infiltration and increased antigenicity. Nat Commun. 10(1):5228 (2019).
Anker P, et al. Immunological aspects of circulating DNA. Annals of the New York Academy of Sciences. vol. 1075, 1 (2006): 6 Pages.
Cazes A, et al. A MET Targeting Antibody-Drug Conjugate Overcomes Gemcitabine Resistance in Pancreatic Cancer. Clinical cancer Research. vol. 27, 7 (2021): 11 Pages.
Cheng, Feifei et al. Circulating tumor DNA: a promising biomarker in the liquid biopsy of cancer. Oncotarget vol. 7,30 (2016): 48832-48841.
Chong Z-S, et al. Pooled extracellular receptor-ligand interaction screening using CRISPR activation. Genome Biology. vol. 19, 1 (2018): 16 Pages.

(Continued)

*Primary Examiner* — Ekaterina Poliakova-Georgantas
(74) *Attorney, Agent, or Firm* — WILSON SONSINI GOODRICH & ROSATI

(57) ABSTRACT

The present disclosure provides nucleic acid sequences and nucleic acid delivery constructs comprising "zip code" sequence(s) that home, target, cross a cytoplasm, and/or cross a nuclear membrane of a target cell (e.g., a diseased cell such as a cancer cell) or cell population (e.g., tissue), and integration sequence(s) that allow for integration of at least a portion of such nucleic acid or nucleic acid delivery system into a genome of such target cell. The present disclosure also provides non-naturally occurring nucleic acid constructs and delivery systems comprising such Zip Code and integration sequences as well as one or more cargo molecules that may be coupled covalently or non-covalently to such nucleic acid constructs and systems. Further provided herein are methods of diagnosing and treating diseases such as cancer using the target cell specific nucleic acid constructs and systems described herein.

21 Claims, 44 Drawing Sheets
Specification includes a Sequence Listing.

(56) References Cited

OTHER PUBLICATIONS

Cinar, et al. Cell Specific Recognition and Capture of ctDNA in Multiple Myeloma. Emory University Winship Cancer Institute/ Department of Hematology and Medical Oncology. Blood, 138 (2021): 1 Page.

Co-pending U.S. Appl. No. 202418735738, inventors Johnson; Anthony et al., filed Jun. 6, 2024.

Dewez B. Serum alkaline deoxyribonuclease activity, a sensitive marker for the therapeutic monitoring of cancer patients: methodological aspects. European Journal of Clinical Chemistry and Clinical Biochemistry. vol. 31, 11 (1993): 6 Pages.

Drago JZ, et al. Unlocking the potential of antibody-drug conjugates for cancer therapy. Nature Reviews Clincial Oncology. vol. 18, 6 (2021): 18 Pages.

Garcia PL, et al. Development and histopathological characterization of tumorgraft models of pancreatic ductal adenocarcinoma. PLoS One. vol. 8, 10 (2013): 18 Pages.

Hilbig, et al. The Interaction of CD97/ADGRE5 With β-Catenin in Adherens Junctions Is Lost During Colorectal Carcinogenesis. Frontiers in Oncology. vol. 8, Article. 182 (2018): 12 Pages.

Huang N, et al. Natural display of nuclear-encoded RNA on the cell surface and its impact on cell interaction. Genome Biology. vol. 21, 1 (2020): 23 Pages.

Jachertz D, et al. Transfer of genetic information from T to B lymphocytes in the course of an immune response. Biomedicine 31(6): 153-154 (1979).

Kojima, K. Human transposable elements in Repbase: genomic footprints from fish to humans. Mobile DNA. vol. 9, 2 (2018): 14 Pages.

Korabecna M, et al. Cell-free DNA in plasma as an essential immune system regulator. Scientific reports. vol. 10, 1 (2020): 10 Pages.

Lehmann, MJ and G Sczakiel. Spontaneous uptake of biologically active recombinant DNA by mammalian cells via a selected DNA segment. Gene therapy vol. 12,5 (2005): 446-51.

Li W, et al. MAGeCK enables robust identification of essential genes from genome-scale CRISPR/Cas9 knockout screens. Genome Biology. vol. 15, 12 (2014): 12 Pages.

Park SJ, et al. GENT2: an updated gene expression database for normal and tumor tissues. BMC Medical Genomics. vol. 12, S5 (2019): 8 Pages.

Patel PS, et al. Evaluation of serum alkaline DNase activity in treatment monitoring of head and neck cancer patients. Tumor Biology. vol. 21, 2 (2000): 8 Pages.

PCT/US2023/071229 International Search Report and Written Opinion dated Feb. 2, 2024.

PCT/US22/81039 International Search Report and Written Opinion dated May 15, 2023.

Rahib L, et al. Projecting cancer incidence and deaths to 2030: the unexpected burden of thyroid, liver, and pancreas cancers in the United States. Cancer Research. vol. 74, 11 (2014): 11 Pages.

Ravindranathan S, et al. Targeting vasoactive intestinal peptide-mediated signaling enhances response to immune checkpoint therapy in pancreatic ductal adenocarcinoma. Nature Communications. vol. 13, 1 (2022): 18 Pages.

Rawla P, et al. Epidemiology of Pancreatic Cancer: Global Trends, Etiology and Risk Factors. World Journal of Oncology. vol. 10, 1 (2019): 18 Pages.

Rogers JC, et al. Capping of DNA on phytohemagglutinin-stimulated human lymphoblasts. Journal of Immunology. vol. 126, 2 (1981): 3 Pages.

Sarr A, et al. Genome-scale CRISPR/Cas9 screen determines factors modulating sensitivity to ProTide NUC-1031. Scientific Reports. vol. 9, 1 (2019): 13 Pages.

Shukla SA, et al. Comprehensive analysis of cancer-associated somatic mutations in class I HLA genes. Nature Biotechnology. vol. 33, 11 (2015): 10 Pages.

Taper HS, et al. Altered deoxyribonuclease activity in cancer cells and its role in non toxic adjuvant cancer therapy with mixed vitamins C and K3. Anticancer Research. vol. 28, 5A (2008): 6 Pages.

Zeng S, et al. Chemoresistance in Pancreatic Cancer. International Journal of Molecular Sciences. vol. 20, 18 (2019): 19 Pages.

Zhang, L et al. The interplay of circulating tumor DNA and chromatin modification, therapeutic resistance, and metastasis. Molecular Cancer. vol. 18, 36 (2019): 20 Pages.

Berg, et al. ilastik: interactive machine learning for (bio)image analysis. Nature Methods, 2019 (Sep. 2019), Nr. 16. pp. 1-9.

Bogu, Gireesh K. et al. Atlas of transcriptionally active transposable elements in human adult tissues. bioRxiv, 714212 (2019).

Cata, J. P. et al. Inflammatory response, immunosuppression, and cancer recurrence after perioperative blood transfusions. British journal of anesthesia vol. 110,5 (2013): 690-701.

Chikhi, Rayan, and Paul Medvedev. Informed and automated k-mer size selection for genome assembly. Bioinformatics (Oxford, England) vol. 30,1 (2014): 31-7.

Chung, N. et al . . . Transcriptome analyses of tumor-adjacent somatic tissues reveal genes co-expressed with transposable elements. Mobile DNA 10, 39 (2019).

El Baidouri, Moaine et al. Widespread and frequent horizontal transfers of transposable elements in plants. Genome research vol. 24,5 (2014): 831-8.

Emamalipour, M., et al. Horizontal Gene Transfer: From Evolutionary Flexibility to Disease Progression. Front Cell Dev Biol 8 (2020).

EP19864373.6 European Search Report dated Jun. 9, 2022.

Goubran, H..A., et al. Impact of Transfusion on Cancer Growth and Outcome. Cancer growth and metastasis 9, 1-8 (2016).

Gu, Zuguang et al. Circlize Implements and enhances circular visualization in R. Bioinformatics (Oxford, England) vol. 30,19 (2014): 2811-2.

Hjalgrim, H., et al. Cancer incidence in blood transfusion recipients. Journal of the National Cancer Institute 99, 1864-1874 (2007).

Howard, G. et al. Activation and transposition of endogenous retroviral elements in hypomethylation induced tumors in mice. Oncogene 27 (2008): 404-408.

Jin, H. et al. Specific recognition of a dsDNA sequence motif by an immunoglobulin VH homodimer. Protein Sci 13, (2004): 3222-3229.

Kavak, P., et al. Discovery and genotyping of novel sequence insertions in many sequenced individuals. Bioinformatics 33, i161-i169 (2017).

Kurtz, et al. Versatile and open software for comparing large genomes. Genome Biol. 2004;5(2):R12. doi: 10.1186/gb-2004-5-2-r12. Epub Jan. 30, 2004.

Langmead et al. Fast gapped-read alignment with Bowtie 2. Nature Methods 9:357-359 (2012).

Li, et al. Fast and accurate long-read alignment with Burrows-Wheeler transform. Bioinformatics. Mar. 1, 2010;26(5):589-595. doi: 10.1093/bioinformatics/btp698. Epub Jan. 15, 2010.

Li, H., et al. Fast and accurate short read alignment with Burrows-Wheeler transform. Bioinformatics 25 (2009): 1754-1760.

Li, W., et al. Cd-hit: a fast program for clustering and comparing large sets of protein or nucleotide sequences. Bioinformatics 22 (2006): 1658-1659.

Musat, et al. HIV-1 integrase inhibitors targeting various DDE transposases: Retroviral integration versus RAG-mediated recombination. Mol Med Rep. Dec. 2019; 20(6): 4749-4762. Published online Oct. 30, 2019. doi: 10.3892/mmr.2019.10777.

Munevver, Cinar. Retrotransposons facilitate the tissue-specific horizontal transfer of circulating tumor DNA between human cells. bioRxiv (2022).

Nurk, et al. Assembling single-cell genomes and mini-metagenomes from chimeric MDA products. J Comput Biol. Oct. 2013;20(10):714-737. doi: 10.1089/cmb.2013.0084.

Ohlfest, John R et al. Integration and long-term expression in xenografted human glioblastoma cells using a plasmid-based transposon system. Molecular therapy : the journal of the American Society of Gene Therapy vol. 10,2 (2004): 260-8.

(56) References Cited

OTHER PUBLICATIONS

Price, V. J., et al. Enterococcus faecalis CRISPR-Cas Is a Robust Barrier to Conjugative Antibiotic Resistance Dissemination in the Murine Intestine. mSphere 4 (2019): e00464-00419.
Sandmann, et al. Evaluating Variant Calling Tools for Non-Matched Next-Generation Sequencing Data. Sci Rep. Feb. 24, 2017;7:43169. doi: 10.1038/srep43169.
Schindelin, et al. Fiji: an open-source platform for biological-image analysis. Nat Methods. Jun. 28, 2012;9(7):676-682. doi: 10.1038/nmeth.2019.
Simpson, J.T., et al. ABySS: a parallel assembler for short read sequence data. Genome Res 19 (2009): 1117-1123.
Soni, C. et al. DNA as a self-antigen: nature and regulation. Curr Opin Immunol 55, (2018): 31-37.
Sun, T., et al. Two hAT transposon genes were transferred from Brassicaceae to broomrapes and are actively expressed in some recipients. Scientific Reports 6, 30192 (2016).
Yang, T.O., et al. Cancer risk among 21st-century blood transfusion recipients. Annals of oncology: official journal of the European Society for Medical Oncology 28, (2017): 393-399.
An, et al. Aromatic Interactions Modulate the 5'-Base Selectivity of the DNA-Binding Autoantibody ED-10. The Journal of Physical Chemistry B. May 2014. 118(21):5653-5659. DOI: 10.1021/jp502069a.
Anker, et al. Spontaneous release of DNA by human blood lymphocytes as shown in an in vitro system. Cancer Res. Sep. 1975;35(9):2375-2382.
Anker, et al. The role of extracellular DNA in the transfer of information from T to B human lymphocytes in the course of an immune response. J Immunogenet. Dec. 1980;7(6):475-481. doi: 10.1111/j.1744-313x.1980.tb00742.x.
Balaj, et al. Tumour microvesicles contain retrotransposon elements and amplified oncogene sequences. Nat Commun. Feb. 2011; 2: 180.
Bedrosian, et al. Early life experience drives structural variation of neural genomes in mice. Science. Mar. 23, 2018;359(6382):1395-1399.
Bergsmedh, et al. Horizontal transfer of oncogenes by uptake of apoptotic bodies. Proc Natl Acad Science USA, vol. 98, No. 11, pp. 6407-6411, (2001).
Bergthorsson, et al. Widespread horizontal transfer of mitochondrial genes in flowering plants. Nature. Jul. 10, 2003;424(6945):197-201. doi: 10.1038/nature01743.
Bichsel, et al. The early phase of a bacterial insertion sequence infection. Theor Popul Biol. Dec. 2010;78(4):278-288. doi: 10.1016/j.tpb.2010.08.003. Epub Sep. 15, 2010.
Bouuaert, et al. Gene therapy vectors: the prospects and potentials of the cut-and-paste transposons. Genetica. May 2010;138(5):473-84.
Burrell, et al. The causes and consequences of genetic heterogeneity in cancer evolution. Nature. Sep. 19, 2013;501(7467):338-345. doi: 10.1038/nature12625.
Cai, et al. The cGAS-cGAMP-STING pathway of cytosolic DNA sensing and signaling. Mol Cell. Apr. 24, 2014;54(2):289-296. doi: 10.1016/j.molcel.2014.03.040.
Canella, et al. Defining the RNA polymerase III transcriptome: Genome-wide localization of the RNA polymerase III transcription machinery in human cells. Genome Res. Jun. 2010;20(6):710-721. doi: 10.1101/gr.101337.109. Epub Apr. 22, 2010.
Carnevali, et al. Whole-genome expression analysis of mammalian-wide interspersed repeat elements in human cell lines. DNA Res. Feb. 1, 2017;24(1):59-69. doi: 10.1093/dnares/dsw048.
Chen, et al. Engineered Viruses as Genome Editing Devices. Mol Ther. Mar. 2016; 24(3): 447-457.
Chen, et al. Regulation and function of the cGAS-STING pathway of cytosolic DNA sensing. Nature immunology 17.10 (2016): 1142-1149.
Clancy S. Genetic Recombination. Nature Education 1(1):40. 2008. URL: https://www.nature.com/scitable/topicpage/genetic-recombination-514/.
Cuecas, et al. Evidence of horizontal gene transfer by transposase gene analyses in *Fervidobacterium* species. PLoS One. Apr. 20, 2017;12(4):e0173961. doi: 10.1371/journal.pone.0173961. eCollection 2017.
Dagogo-Jack, et al. Tumour heterogeneity and resistance to cancer therapies. Nat Rev Clin Oncol. Feb. 2018;15(2):81-94. doi: 10.1038/nrclinonc.2017.166. Epub Nov. 8, 2017.
Dvorakova, et al. DNA released by leukemic cells contributes to the disruption of the bone marrow microenvironment. Oncogene 32.44 (2013): 5201-5209.
Feschotte, et al. DNA Transposons and the Evolution of Eukaryotic Genomes. Annu Rev Genet. 2007; 41: 331-368.
Frost, et al. Mobile genetic elements: the agents of open source evolution. Nat Rev Microbiol. Sep. 2005;3(9):722-732. doi: 10.1038/nrmicro1235.
Fuentes, et al. Horizontal genome transfer as an asexual path to the formation of new species. Nature. Jul. 10, 2014;511(7508):232-235. doi: 10.1038/nature13291. Epub Jun. 8, 2014.
Gahan, et al. The virtosome—a novel cytosolic informative entity and intercellular messenger. Cell Biochem Funct. Oct. 2010;28(7):529-538. doi: 10.1002/cbf.1690.
García-Olmo, et al. Cell-free nucleic acids circulating in the plasma of colorectal cancer patients induce the oncogenic transformation of susceptible cultured cells. Cancer Res. Jan. 15, 2010;70(2):560-567. doi: 10.1158/0008-5472.CAN-09-3513. Epub Jan. 12, 2010.
Gilbert, et al. Horizontal transfer and evolution of prokaryote transposable elements in eukaryotes. Genome Biol Evol. 2013;5(5):822-832. doi: 10.1093/gbe/evt057.
Hare, et al. Molecular mechanisms of retroviral integrase inhibition and the evolution of viral resistance. Proc Natl Acad Sci USA. Nov. 16, 2010; 107(46): 20057-20062. Published online Oct. 28, 2010. doi: 10.1073/pnas.1010246107.
Huang, et al. Widespread of horizontal gene transfer in the human genome. BMC Genomics. Apr. 4, 2017;18(1):274. 11 pages. doi: 10.1186/s12864-017-3649-y.
Hubley, et al. The Dfam database of repetitive DNA families. Nucleic Acids Res. Jan. 4, 2016; 44(Database issue): D81-D89. Published online Nov. 26, 2015. doi: 10.1093/nar/gkv1272.
Iskow, Rebecca C. et al. Natural Mutagenesis of Human Genomes by Endogenous Retrotransposons, Cell 141(1):1253-1261 (Jun. 1, 2010).
Johnston, et al. Bacterial transformation: distribution, shared mechanisms and divergent control. Nat Rev Microbiol. Mar. 2014;12(3):181-196. doi: 10.1038/nrmicro3199. Epub Feb. 10, 2014.
Jurka, et al. Censor—a program for identification and elimination of repetitive elements from DNA sequences. Computers & Chemistry 20:119-121, 1996.
Kapitonov, et al. Anthology of Human Repetitive DNA. Reviews in Cell Biology and Molecular Medicine. First published: Sep. 15, 2006. doi:10.1002/3527600906.mcb.200300166.
Kawai, et al. The role of pattern-recognition receptors in innate immunity: update on Toll-like receptors. Nat Immunol. May 2010;11(5):373-84.
Khelik, et al. NucDiff: in-depth characterization and annotation of differences between two sets of DNA sequences. BMC Bioinformatics. Published Jul. 12, 2017. 18(338): 12 pages. https://doi.org/10.1186/s12859-017-1748-z.
Kim, et al. A guide to genome engineering with programmable nucleases. Nat Rev Genet. May 2014;15(5):321-34. doi: 10.1038/nrg3686. Epub Apr. 2, 2014.
Klecka, et al. Autoantibody Profiling in Lupus Patients using Synthetic Nucleic Acids. Sci Rep. Published Apr. 3, 2018. 8(5554): 9 pages. https://doi.org/10.1038/s41598-018-23910-5.
Krull, et al. Functional persistence of exonized mammalian-wide interspersed repeat elements (MIRs). Genome Res. Aug. 2007;17(8):1139-1145. doi: 10.1101/gr.6320607. Epub Jul. 10, 2007.
Levin, et al. Dynamic interactions between transposable elements and their hosts. Nat Rev Genet. Aug. 18, 2011; 12(9): 615-627.
Lou, et al. A novel Alu-based real-time PCR method for the quantitative detection of plasma circulating cell-free DNA: sensitivity and specificity for the diagnosis of myocardial infarction. International journal of molecular medicine 35.1 (2015): 72-80.

(56) References Cited

OTHER PUBLICATIONS

Ma, et al. The cGAS-STING defense pathway and its counteraction by viruses. Cell host & microbe19.2 (2016): 150-158.
Maeder et al., Genome-editing Technologies for Gene and Cell Therapy. Mol Ther. 24.3 (2016): 430-446.
Morita, et al. C4b binding protein negatively regulates TLR1/2 response. Innate Immun. Jan. 2017;23(1):11-19.
Munoz-Lopez, et al. DNA transposons: nature and applications in genomics. Curr Genomics. Apr. 2010;11(2):115-28.
Payne, et al. The causes of evolvability and their evolution. Nat Rev Genet. Jan. 2019;20(1):24-38. doi: 10.1038/s41576-018-0069-z.
PCT/US2019/052680International Search Report and Written Opinion dated Feb. 3, 2020.
Peccoud, et al. Massive horizontal transfer of transposable elements in insects. Proc Natl Acad Sci USA. May 2, 2017;114(18):4721-4726. doi: 10.1073/pnas.1621178114. Epub Apr. 17, 2017.
Probst, et al. Homologous Recombination and Transposon Propagation Shape the Population Structure of an Organism from the Deep Subsurface with Minimal Metabolism. Genome Biol Evol. Apr. 2018; 10(4): 1115-1119. Published online Mar. 19, 2018. doi: 10.1093/gbe/evy067.
Pullkinen, et al. An assay to monitor the activity of DNA transposition complexes yields a general quality control measure for transpositional recombination reactions. Mobile genetic elements 4.5 (2014): 1-8.
Quispe-Huamanquispe, et al. Horizontal Gene Transfer Contributes to Plant Evolution: The Case of Agrobacterium T-DNAs. Front Plant Sci. Nov. 24, 2017;8:2015. doi: 10.3389/fpls.2017.02015. eCollection 2017.
Ramachandiran, et al. Chromosome instability in diffuse large B cell lymphomas is suppressed by activation of the noncanonical NF-κB pathway. International Journal of Cancer 136:2341-2351, 2015.
Richardson, et al. Horizontal gene transfer in plants. Journal of Experimental Botany 58:1-9, 2006.
Schaack, et al. Promiscuous DNA: horizontal transfer of transposable elements and why it matters for eukaryotic evolution. Trends in Ecology & Evolution. Sep. 2010. 25(9):537-546. https://doi.org/10.1016/j.tree.2010.06.001.
Schwarzenbach et al. Cell-free nucleic acids as biomarkers in cancer patients. Nat Rev Cancer 11:426-437 (2011).
Smit, et al. RepeatMasker Open-3.0. Available at http://www.repeatmasker.org, 1996-2004; Accessed on Nov. 1, 2019.
Stollar, et al. A recognition site on synthetic helical oligonucleotides for monoclonal anti-native DNA autoantibody. Proceedings of the National Academy of Sciences 83.12 (1986): 4469-4473.
Stroun et al. The origin and mechanism of circulating DNA. Ann N Y Acad Sci 906:161-168 (2000).
Sung, et al. Mechanism of homologous recombination: mediators and helicases take on regulatory functions. Nat Rev Mol Cell Biol. Oct. 2006;7(10):739-750. doi: 10.1038/nrm2008. Epub Aug. 23, 2006.
Thierry, et al. Origins, structures, and functions of circulating DNA in oncology. Cancer Metastasis Rev. Sep. 2016;35(3):347-376. doi: 10.1007/s10555-016-9629-x.
Trejo-Becerril, et al. Cancer progression mediated by horizontal gene transfer in an in vivo model. PLoS One 7.12 (2012): e52754.
Wallau, et al. Genetic exchange in eukaryotes through horizontal transfer: connected by the mobilome. Mobile DNA. Jan. 31, 2018;9:6. 16 pages. doi: 10.1186/s13100-018-0112-9. eCollection 2018.
Wolkowicz, et al. Structural basis of Mos1 transposase inhibition by the anti-retroviral drug Raltegravir. ACS Chem Biol. Mar. 21, 2014;9(3):743-751. doi: 10.1021/cb400791u. Epub Jan. 10, 2014.
Wozniak, et al. Integrative and conjugative elements: mosaic mobile genetic elements enabling dynamic lateral gene flow. Nat Rev Microbiol. Aug. 2010;8(8):552-563. doi: 10.1038/nrmicro2382. Epub Jul. 5, 2010.
Yant, et al. Site-directed transposon integration in human cells. Nucleic Acids Res. Apr. 2007; 35(7): e50.
Zhang, et al. Genome-wide high-resolution mapping and functional analysis of DNA methylation in *Arabidopsis*. Cell. Sep. 22, 2006;126(6):1189-201. Epub Aug. 31, 2006.

| ID | From | To | Name | Class | Direction |
|---|---|---|---|---|---|
| 1 | 203 | 486 | AluY | NonLTR/SINE/SINE1 | c |
| 2 | 1325 | 1517 | AluJ | Interspersed_Repeat | c |
| 3 | 1609 | 1697 | EnSpm-21_DR | DNA/EnSpm/CACTA | d |
| 4 | 1910 | 2058 | L2C | NonLTR/L2 | d |
| 5 | 2273 | 2339 | IMPB_02 | Simple | c |
| 6 | 2361 | 2438 | MER5A | DNA/hAT | d |
| 7 | 2652 | 2766 | Mariner-30_SSa | DNA/Mariner | c |
| 8 | 4016 | 4080 | Sagan-5_TMe | DNA/Mariner | c |
| 9 | 4321 | 4347 | L1-1_HArab | NonLTR/L1 | d |
| 10 | 4462 | 4529 | MuDR-N77_OS | DNA/MuDR | d |
| 11 | 5443 | 5527 | Gypsy-31_ADe-I | LTR/Gypsy | d |
| 12 | 6960 | 7068 | MamGypLTR3 | LTR/Gypsy | d |
| 13 | 7119 | 7238 | AluJb | NonLTR/SINE/SINE1 | c |
| 14 | 7749 | 7811 | MIRc | NonLTR/SINE/SINE2 | c |
| 15 | 9065 | 9141 | VLINE8_VV | NonLTR/L1 | c |
| 16 | 9800 | 9864 | MER63D | DNA/hAT | d |
| 17 | 9866 | 9982 | MER63A | DNA | d |
| 18 | 10015 | 10092 | MLT2B3 | ERV/ERV3 | c |
| 19 | 10101 | 10542 | MLT2A1 | ERV/ERV3 | c |
| 20 | 11108 | 11147 | ZFERV-2-I_DR | ERV/ERV1 | d |
| 21 | 11572 | 11632 | Copia-28_Ano-LTR | LTR/Copia | d |
| 22 | 11815 | 12092 | AluSg | NonLTR/SINE/SINE1 | c |
| 23 | 12107 | 12311 | L1ME4A | NonLTR/L1 | d |
| 24 | 12449 | 12511 | Copia-64_PPe-I | LTR/Copia | d |
| 25 | 12816 | 12878 | Gypsy-30-I_DR | LTR/Gypsy | d |
| 26 | 12926 | 12969 | Caulimovirus-8_ATr | rus | d |
| 27 | 13134 | 13661 | MLT1E | ERV/ERV3 | d |
| 28 | 13668 | 13756 | Charlie22a | DNA/hAT | c |
| 29 | 14037 | 14319 | AluSc | NonLTR/SINE/SINE1 | d |
| 30 | 14508 | 14791 | AluSp | NonLTR/SINE/SINE1 | c |
| 31 | 14839 | 15117 | AluSz | NonLTR/SINE/SINE1 | c |
| 32 | 15253 | 15432 | AluJo | NonLTR/SINE/SINE1 | d |
| 33 | 15518 | 15719 | MER68 | DNA/Mariner | d |
| 34 | 15776 | 15827 | Academ-1_GA | DNA/Academ | d |

FIG. 8B

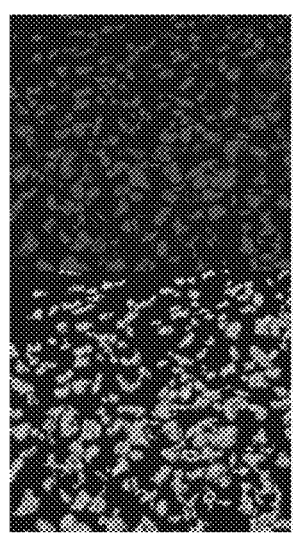 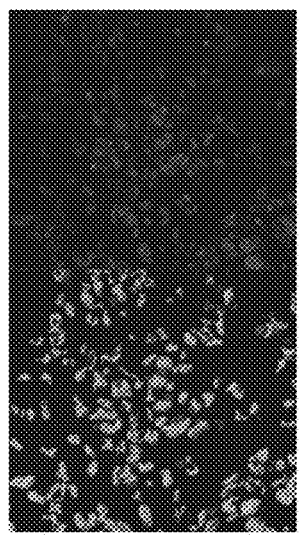 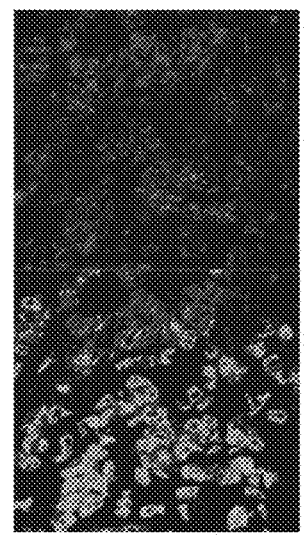
FIG. 10A     FIG. 10B     FIG. 10C
FIG. 10

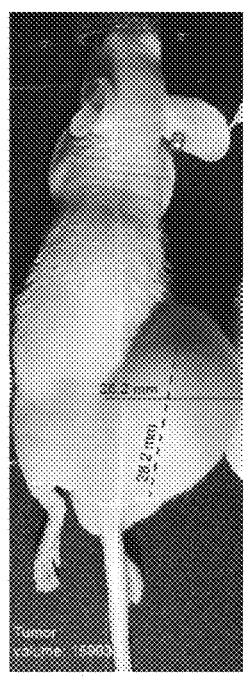 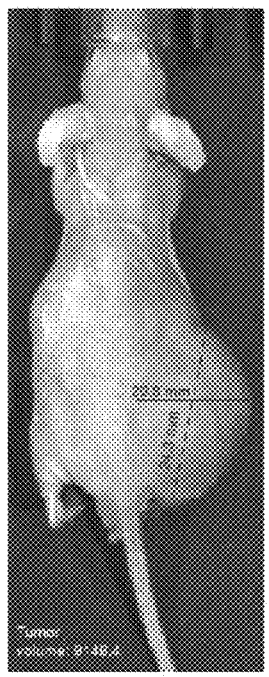 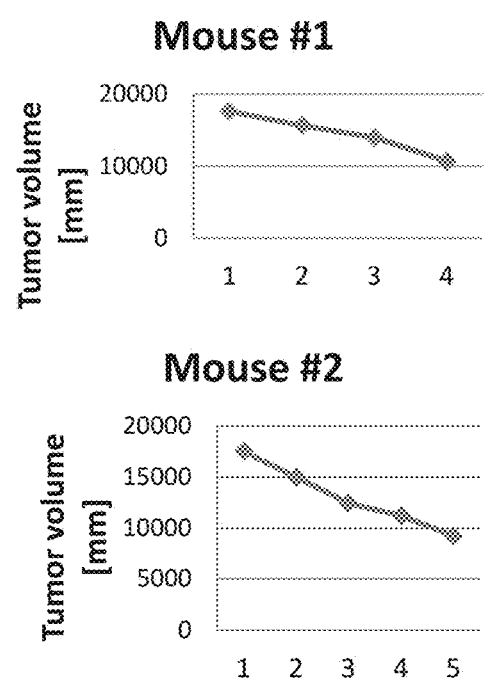
FIG. 13A  FIG. 13B  FIG. 13C
FIG. 13

MM cells+ MM ctDNA

Lung Cancer cells +
Lung Cancer (LC) ctDNA

Colon Cancer cells +
Colon Cancer ctDNA

Pancreatic Cancer cells +
Pancreatic Cancer (PC) ctDNA

NUCLEIC ACIDS FOR CELL RECOGNITION AND INTEGRATION

CROSS-REFERENCE

This application is a continuation of International Application Serial No. PCT/US2019/052680, filed Sep. 24, 2019, which claims the benefit of U.S. Provisional Application Nos. 62/875,887, filed Jul. 18, 2019; and 62/736,323, filed Sep. 25, 2018, which applications are incorporated herein by reference in their entirety for all purposes.

SEQUENCE LISTING

The instant application contains a Sequence Listing which has been submitted electronically in ASCII format and is hereby incorporated by reference in its entirety. Said ASCII copy, created on Mar. 24, 2021, is named 54774702301SL.txt and is 793,826 bytes in size.

BACKGROUND

A transposable element (TE or transposon) is a DNA sequence that can change its position within a genome, sometimes creating or reversing mutations and altering the cell's genetic identity and genome size. Transposable elements have previously been associated with various diseases including cancer, but their relationship to the onset of the disease, if any exists, needs to be better understood. For example, cancer is the second most common cause of death in the United States, with more than 1,600 cancer related deaths per day, nearly 600,000 per year. Approximately 1.65 million new cases of cancer were diagnosed in 2015 and cancer incidence is increasing due to demographic and lifestyle factors. Thus, there exists an unmet need for sensitive, effective and particularly cell-, tissue-, and/or organ-specific compositions and methods for detection and treatment of cancer as well as other chronic, infectious or age-related diseases.

SUMMARY

In various aspects, the present disclosure provides nucleic acid constructs comprising a deoxyribonucleic acid sequence that directs a migration of the construct to a target tissue in-vivo (tropism). The construct can comprise two or more sequences derived from a transposon, for instance, a 3' sequence and a 5' sequence, for integration into a cell of the target tissue.

In various aspects, the disclosure describes various pharmaceutical compositions comprising sequences that direct a migration of the construct to a target tissue or a target cell in-vivo (tropism). In some instances the disclosure provides a pharmaceutical composition comprising a therapeutically effective amount of a nucleic acid construct comprising a) a first deoxyribonucleic acid (DNA) sequence that directs a migration of said nucleic acid construct to a pre-selected tissue in vivo; and b) a second deoxyribonucleic acid sequence that directs an integration of a region of said nucleic acid construct into a genome of a cell from said pre-selected tissue in vivo; which composition is formulated for administration to a subject. In some embodiments, said first deoxyribonucleic acid sequence is from a same cell type as said cell from said pre-selected tissue. In some embodiments, said subject is a human. In some embodiments, said first deoxyribonucleic acid sequence migrates to a white blood cell. In some embodiments, said first deoxyribonucleic acid sequence migrates to a pancreatic cell. In some embodiments, said first deoxyribonucleic acid sequence migrates to lung cell. In some embodiments, said nucleic acid construct crosses a nuclear membrane of said cell from said pre-selected tissue when administered to said subject. In some embodiments, said first deoxyribonucleic acid sequence has at least 90% identity to at least 12 bases of any one of SEQ ID NO: 203-SEQ ID NO: 277 and SEQ ID NO: 282. In some embodiments, said first deoxyribonucleic acid sequence is at least 400 base pairs in length. In some embodiments, said first deoxyribonucleic acid sequence is between 400 base pairs and 20,000 base pairs in length. In some embodiments, said second deoxyribonucleic acid sequence has at least 90% homology to a transposon sequence. In some embodiments, said transposon is a class II transposon. In some embodiments, said class II transposon integrates itself into said genome of said cell from said pre-selected tissue via horizontal gene transfer. In some embodiments, said nucleic acid construct that comprises at least one additional deoxyribonucleic nucleic acid sequence. In some embodiments, said at least one additional deoxyribonucleic nucleic acid sequence comprises a tissue selective promoter. In some embodiments, said at least one additional deoxyribonucleic nucleic acid sequence comprises a second integration signal for incorporation into said genome. In some embodiments, said at least one additional deoxyribonucleic nucleic acid sequence comprises a sequence that encodes a peptide or protein. In some embodiments, said at least one additional deoxyribonucleic nucleic acid sequence comprises a sequence for ensuring that said peptide or protein is only expressed in said cell from said pre-selected tissue. In some embodiments, said peptide or said protein encodes a tumor suppressor peptide or a tumor suppressor protein. In some embodiments, said tumor suppressor peptide or said tumor suppressor protein is a multiple myeloma tumor suppressor gene. In some embodiments, said tumor suppressor peptide or said tumor suppressor protein is a pancreatic cancer tumor suppressor gene. In some embodiments, said tumor suppressor peptide or said tumor suppressor protein is a lung cancer tumor suppressor gene. In some embodiments, said tumor suppressor peptide or said tumor suppressor protein is any one of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53. In some embodiments, said peptide or said protein encodes an antigenic protein. In some embodiments, said antigenic protein is translated specifically in said cell upon administration to said subject. In some embodiments, said pharmaceutical composition further comprises a cargo. In some embodiments, said cargo is a fluorophore or a radioisotope. In some embodiments, said cargo is a therapeutic drug. In some embodiments, the cargo is covalently attached to said nucleic acid construct. In some embodiments, said formulation comprises a nanoparticle or cationic polymer.

In various aspects, the present disclosure provides a vector comprising a first sequence that has at least 90% sequence identity to at least 12 bases of any one of SEQ ID NO: 203-SEQ ID NO: 277 or SEQ ID NO: 282, or an additional nucleic acid sequence. In some embodiments, said additional nucleic acid sequence has at least 90% homology to a transposon sequence described herein. In some embodiments, said transposon is a class II transposon. In some embodiments, said class II transposon integrates itself into said genome of said cell from said pre-selected tissue via horizontal gene transfer. In some embodiments, said vector comprises at least two additional nucleic acid sequences. In some embodiments, said at least two additional nucleic acid sequences comprise a tissue selective promoter and a transposon sequence. In some embodiments, said at least two additional nucleic acid sequences comprise at least two transposon sequences. In some embodiments, said additional nucleic acid sequence comprises a sequence that encodes a peptide or protein. In some embodiments, said peptide or said protein encodes a tumor suppressor peptide or a tumor suppressor protein. In some embodiments, said tumor suppressor peptide or said tumor suppressor protein is a multiple myeloma tumor suppressor gene. In some embodiments, said tumor suppressor peptide or said tumor suppressor protein is a pancreatic cancer tumor suppressor gene. In some embodiments, tumor suppressor peptide or said tumor suppressor protein is a lung cancer tumor suppressor gene. In some embodiments, said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53. In some embodiments, said vector is covalently linked to a cargo. In some embodiments, said cargo is a fluorophore or a radioisotope. In some embodiments, said cargo is a therapeutic drug.

In various aspects, the present disclosure provides a library of two or more of said vectors.

In various aspects, the present disclosure provides a method for treating a cancer, the method comprising: administering an effective amount of a nucleic acid construct comprising a nucleic acid sequence that directs migration of a cargo to a tissue of a subject suffering from said cancer, which composition is formulated for administration to a subject. In some embodiments, the cancer is a lung cancer. In some embodiments, the cancer is a multiple myeloma. In some embodiments, the cancer is a pancreatic cancer. In some embodiments, said nucleic acid construct crosses a nuclear membrane in a cell of said tissue cell upon administration to said subject. In some embodiments, said nucleic acid sequence that directs migration of said cargo to said tissue has at least 90% identity to at least 12 bases of any one of SEQ ID NO: 203-SEQ ID NO: 277 or SEQ ID NO: 282. In some embodiments, said nucleic acid construct comprise a transposon for integration into a genome of a cell of said tissue. In some embodiments, said transposon is at least 400 base pairs in length. In some embodiments, said transposon is between 400 base pairs and 20,000 base pairs in length. In some embodiments, said transposon is a class II transposon. In some embodiments, said nucleic acid construct comprises at least one additional nucleic acid sequence that is heterologous to a cell of said tissue. In some embodiments, said at least one additional nucleic acid sequence comprises a tissue selective promoter. In some embodiments, said at least one additional nucleic acid sequence comprises a sequence that encodes a peptide or protein. In some embodiments, said at least one additional nucleic acid sequence comprises an integration signal for incorporation into a target genome. In some embodiments, said at least one additional nucleic acid sequence comprises a guide sequence for targeting said cell. In some embodiments, said at least one additional nucleic acid sequence comprises a sequence that encodes a peptide or a protein. In some embodiments, said peptide or said protein encodes a tumor suppressor peptide or a tumor suppressor protein. In some embodiments, said tumor suppressor peptide or said tumor suppressor protein is a multiple myeloma tumor suppressor gene. In some embodiments, said tumor suppressor peptide or said tumor suppressor protein is a pancreatic cancer tumor suppressor gene. In some embodiments, said tumor suppressor peptide or said tumor suppressor protein is a lung cancer tumor suppressor gene. In some embodiments, said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53. In some embodiments, said peptide or said protein encodes an antigenic protein. In some embodiments, said antigenic protein is translated specifically in a cell of said tissue upon administration to said subject. In some embodiments, said nucleic acid construct is covalently linked to a fluorophore or a radioisotope. In some embodiments, said nucleic acid construct is covalently linked to a therapeutic drug.

In some instances, the present disclosure provides a nucleic acid construct comprising a first DNA sequence and a second DNA sequence, wherein such first DNA sequence can be a targeting sequence capable of directing the construct to a specific organ, tissue, and/or cell, and wherein the second DNA sequence can be an integration sequence capable of integrating at least a region or portion of the construct into a genome of a cell of the specific organ or tissue. In some instances, the first (cell-targeting/recognition) and second (integration) DNA sequence can be part of a Zip Code Sequence (ZCS), a transposon or a transposable element. Such ZCS or transposon can comprise a cell targeting and recognition sequence that can comprise a nucleotide sequence having at least about 80%, 85%, 90%, 95%, 97%, 99%, or 100% sequence identity any one of SEQ ID NO: 203-SEQ ID NO: 277 or SEQ ID NO: 282, or at least about 80%, 85%, 90%, 95%, 97%, 99%, or 100% sequence identity to a fragment thereof. Such fragment can be at least about 8, 10, 12, 15, 20, 25, or 30 nucleotides in length. In some instances, such transposon can be a class II transposon.

In some instances, such nucleic acid construct can serve as a vehicle for transferring genes between cancer cells as well as used to transport a cargo (e.g., a nucleic acid, a protein, a small molecule, or a nanoparticle) into a cell, wherein such cell can be of the same origin as the cell that the first and/or second nucleic acid sequence is derived (or was excreted) from. As described further herein, transfer of genetic material such as ctDNA into a cell (e.g., tumor cell) can alter the clonal architecture of cells and may determine the fate of such cells (e.g., tumor cells) to environmental changes, such as drug treatment.

In some instances, the present disclosure also provides various surprising and unexpected attributes of the nucleic acid constructs described herein. Such unique attributes can include tropism, which can be defined herein as an ability of the construct to target and/or enter cells that are of the same of similar origin to those from which the first (targeting) sequence and/or second (integration) sequence are derived from. In various instances, such targeting and/or integration sequences of a nucleic acid construct herein can be derived from a circulating tumor DNA (ctDNA). Another example of such attributes of the constructs provided herein can include ability to distinguish between cells of similar origin and cells that originated from a different tissue or organ. As an example, a nucleic acid construct comprising a first DNA sequence and a second DNA sequence that are derived from ctDNA that originated from multiple myeloma (MM) tumor cells can target, enter, and/or integrate into a genome of MM cells with high specificity compared to cells of other tumors, such as pancreatic cancer (PC), lung cancer, or colon cancer. Such specificity can be at least about 80%, 85%, 90%, 95%, 97%, or 99%. Furthermore, such construct can target MM cells from different cell lines. As such, for example, the MM-specific nucleic acid construct can be used in vitro to, e.g., transport a cargo into MM cells (e.g., MM1S cells), or in vivo to transport the cargo into MM cells of a tumor of a subject (e.g., a rodent or a human).

The present disclosure further provides functional assays that can be used to identify such unique targeting and/or integration sequences (e.g., ZCSs or transposons) that allow for cell targeting and recognition and insertion into a genome of the cell (e.g., a cancer cell), respectively. For instance, cell-specific recognition sequences and/or genomic integration sequences for use in delivery systems can be identified as described in EXAMPLE 2 herein. In some instances, a ctDNA that can be used to generate such targeting and/or integration sequences can be obtained from a subject, e.g., from the blood plasma of the subject. Such subject can be a human. The human subject can be one that has been diagnosed with a disease such as cancer. In some aspects, the disclosure provides a method for identifying a nucleic acid sequence that migrates to a tissue or a cell of substantially similar origin (tropism) comprising: (a) isolating circulating tumor nucleic acids from a biological sample, thereby producing a set of isolated tumor nucleic acids; (b) adding a barcode to said set of isolated circulating tumor nucleic acids, thereby providing a plurality of barcoded tumor nucleic acids; (c) adding at least one barcoded tumor nucleic acid from the plurality of barcoded tumor nucleic acids to a population of cells under conditions that allow for integration of the tissue tropic sequences, thereby producing a cultured population of cells; (d) sequencing the cultured population of cells, thereby producing a plurality of sequencing reads; (e) analyzing the sequencing reads by a computer to identify a presence or an absence of at least one sequencing read from the plurality of sequencing reads comprising a barcode; and (f) analyzing the sequencing reads comprising the barcode to identify a presence or an absence of a sequence that is present on the cultured population of cells but absent in the population of cells, thereby identifying the nucleic acid sequence that migrated to the tissue or the cell of interest.

In some embodiments, the present disclosure provides synthetically generated transposons that can be derived from such ctDNA and that can be used to deliver a cargo (e.g., a nucleic acid, a protein, a small molecule, or a nanoparticle) into one or more target cell(s). In some instances, and as described herein, such synthetically generated transposons or ZCS (e.g., oligo-ZCS) can be part of a nucleic acid construct that can be used as a tool to deliver cargo with high specificity to cells, e.g., cancer cells, both in vivo and in vitro. Thus, in some instances, such nucleic acid construct can be part of a delivery system. Such delivery system can have one or more components. Such components can include (i) a ZCS sequence comprising a first DNA sequence for targeting a certain cell, cell population, or tissue, and a second DNA sequence for integration of at least a region or portion of such delivery system into a genome of such target cell, cell population, or tissue; a (ii) promoter sequence; and (iii) one or more cargos, or any combination thereof. Such one or more cargos can include (a) one or more nucleic acid (e.g., DNA) sequences such as genes or gene fragments that can be expressed in such target cells or tissue, and (b) one or more additional cargos such as proteins, nanoparticles, or small molecules. FIG. 12 shows an example of a delivery system described herein. In such system, a cargo (here a gene such as an antigen-coding gene) to be delivered to a target cell can be coupled to a (e.g., tissue-specific) promoter sequence and a guide sequence, which are flanked by ZCSs and/or transposons comprising the first and second DNA sequences, wherein the first DNA sequence (e.g., targeting or Zip Code sequence) is capable of cell targeting, and the second DNA sequence is capable of integrating such system into a genome of the target cell once the system has reached the nucleus of the cell.

In some instances, the present disclosure provides nucleic acid constructs and systems that can transfer certain properties to target cells. Such properties include a target cell's response to changes in the environment. Such changes can include exposure to certain molecules. Such molecule can be drug molecules, such as small molecules or proteins such as antibodies. Examples of such transfer or properties include resistance or sensitivity to a drug from a patient's plasma to cancer cell lines in vitro. Such surprising and unexpected properties can allow for the design of non-naturally occurring nucleic acid constructs comprising one or more (e.g., 2, 3, 4, etc.) ZCS (or transposon) sequences and one or more cargo molecules such as additional nucleic acid sequences encoding for therapeutic and/or diagnostic proteins for the delivery and integration of such constructs, or a portion of such construct, into a genome of a target cell. Such target cell can be a cancer cell and the cargo nucleic acid can code for a variety of therapeutic proteins such as caspases for cancer cell apoptosis, antigens for immune cell recognition or enhancement of immunotherapy, or other proteins such as antibodies, enzymes, cytokines, signaling molecules, etc.

The ZCSs or transposon sequences described herein can comprise one or more transposable elements. Such transposable elements can include mammalian-wide interspersed repeat (MIR) and *Arthrobacter luteus* (ALU) such as ALUsq, as well as derivatives or functional fragments thereof. Thus, in some instances, the present disclosure provides synthetic MIR oligonucleotides (oligos) that can be capable of delivering cargo to target cells such as tumor cells.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

FIG. 6 discloses SEQ ID NOS 280-281, respectively, in order of appearance.

FIG. 8B shows areas of chromosomal integration and that mechanisms may be related to and/or mediated by transposons. Indications of such include the observation that most inserted contig sequences can have high content of transposons; that contig sequences can have different types of transposons; that integration may be configuration dependent; and that cellular recognition of the contig and/or ZC sequences may be receptor-mediated.

FIG. 9A shows confocal microscopy images 24 hours after administration of rhodamine-labeled ctDNA when injected directly into the tumor.

FIG. 9B shows confocal microscopy images 24 hours after administration of rhodamine-labeled ctDNA when injected when injected via the tail vein.

FIG. 9C shows confocal microscopy images 48 hours after administration of rhodamine-labeled ctDNA when injected when injected via the tail vein.

FIG. 9D shows confocal microscopy images of tumor-bearing control mice that were injected via the tail vein with phosphate buffered saline (PBS) 24 hours prior to harvest.

FIG. 10 shows confocal microscopy images of rhodamine-labeled ctDNA constructs present in the tumor after systemic or local administration.

FIG. 10A shows confocal microscopy images of tumor-bearing control mice that were injected via the tail vein with PBS 24 hours prior to harvest.

FIG. 10B shows confocal microscopy images of rhodamine-labeled ctDNA when injected via the tail vein 24 hours prior to harvest.

FIG. 10C shows confocal microscopy images of rhodamine-labeled ctDNA when injected via the tail vein 48 hours prior to harvest.

FIG. 13 shows the change in tumor size of about 50% induced by a combination therapy of Ganciclovir that was administered for 5 days once daily starting 48 hours after administration of the gene construct comprising a multiple myeloma (MM) ZCS nucleic acid molecule (SEQ ID NO: 282) and an HSV-TK gene.

FIG. 13A and FIG. 13B show a comparison of tumor size before and after 5 days of treatment with Ganciclovir.

FIG. 13C shows the change in tumor volume measured in both mice (mouse #1 and mouse #2) that received gene therapy with MM ZIP code-HSV-TK. Treatment with Ganciclovir led to a significant reduction in tumor volume in both animals.

FIG. 19 discloses SEQ ID NOS 280-281, respectively, in order of appearance.

FIG. 24A shows data that demonstrate significant accumulation and uptake of these PC-targeting nucleic acid molecules in PC cells 24, and particularly 48 hours post injection via the tail vein. FIG. 24B shows that uptake in tumor cells was significantly reduced when the PC-derived nucleic acid molecules were injected directly into the tumor, suggesting that the cell-targeting and/or integrating nucleic acid molecules of this disclosure may provide improved cell- and/or tissue recognition and uptake when administered systemically. FIG. 24C shows the control experiment with now ctDNA injected.

DETAILED DESCRIPTION

While various embodiments of the disclosure have been shown and described herein, it will be obvious to those of ordinary skill that such embodiments are provided by way of example. Numerous variations, changes, and substitutions may occur to those of ordinary skill without departing from the disclosure. Moreover, various alternatives to the embodiments of the disclosure described herein may be employed.

Figure 15:
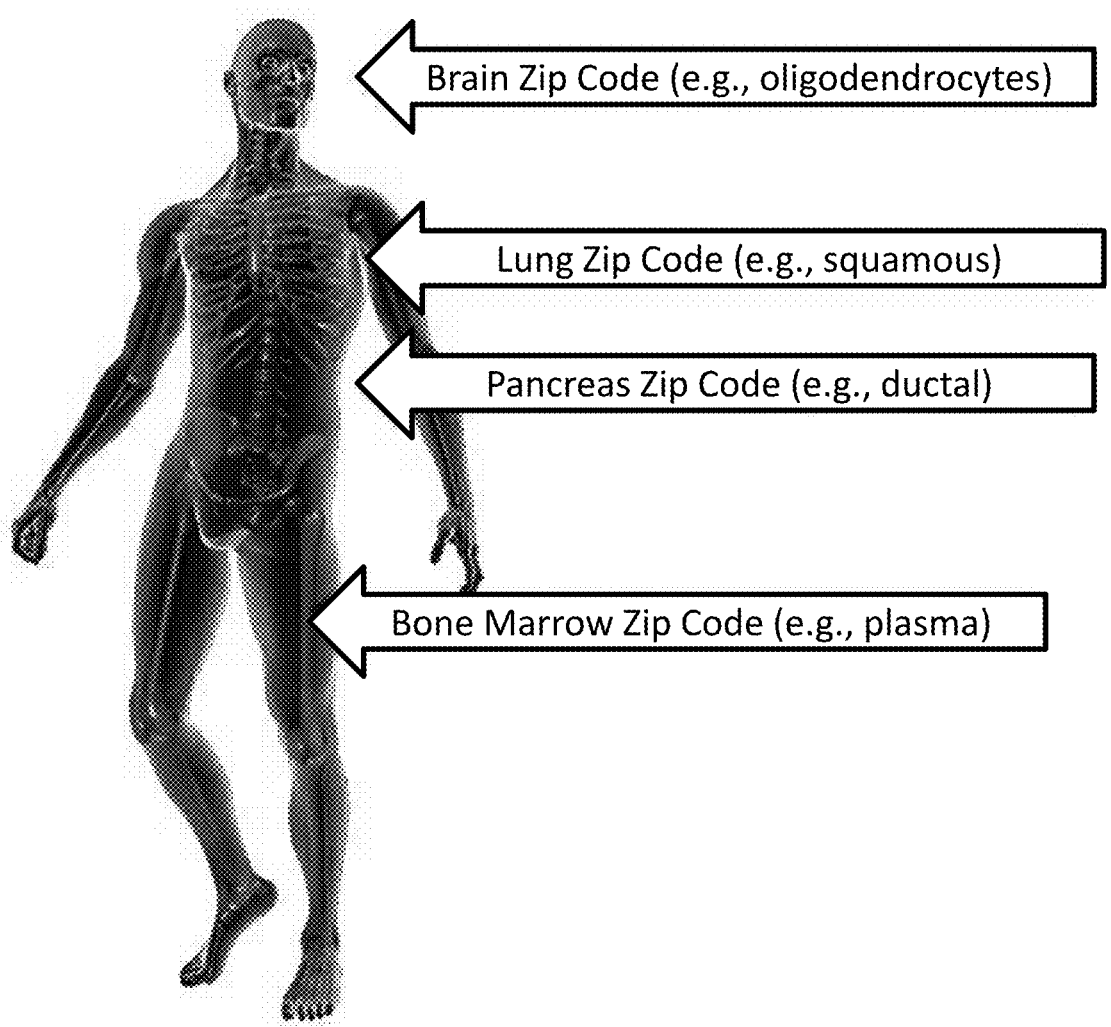
FIG. 15 schematically illustrates tissue and/or organ specific "Zip Code" sequences. The present disclosure provides cell-, tissue-, and/or organ-specific "Zip Code" sequences (also abbreviated herein as "ZCS") that allow cell-, tissue-, and/or organ-specific targeting and/or delivery using such ZCSs.

The present disclosure provides compositions and methods for cell-, tissue-, and/or organ-specific targeting, uptake, nuclear localization and/or genomic integration of a cargo molecule (see, e.g., FIG. 15). Such cargo molecule can include nucleic acid sequences (e.g., DNA sequences encoding a protein such as a therapeutic protein), amino acid sequences (e.g., peptide, proteins, or fragments thereof), and/or small or organic molecules (e.g., small molecule therapeutics or fluorescent dyes). In such instances, the compositions and methods herein can be used for the cell-specific delivery of cargo (e.g., nucleic acid molecules, proteins, peptides, or small molecules such as therapeutic and/or diagnostic molecules, etc.) into a target cell. Sch target cell can be a prokaryotic or a eukaryotic cell (e.g., a tumor cell).

The compositions described herein can include nucleic acid constructs. Such nucleic acid construct can provide for cell-, tissue-, and/or organ-specific targeting, uptake, nuclear localization and/or genomic integration of a cargo molecule. Such nucleic acid construct can comprise a nucleic acid sequence comprising a recognition and/or an integration sequence. In various instances herein, such nucleic acid sequence can comprise a Zip Code Sequence (also abbreviated herein as "ZCS") that can provide for cell-specific targeting and uptake of the nucleic acid construct. Such ZCS can also comprise an integration sequence that allows for integration of the nucleic acid, or a portion thereof, into a genome of a cell. In some instances, such nucleic acid sequence that provides cell targeting and/or genomic integration can be or can comprise a transposon sequence.

The cell targeting (recognition) and integration sequences of the present disclosure can be derived from nucleic acid sequences of a biological sample (e.g., blood or tissue sample of a subject). Such cell targeting and integration sequences may be derived from circulating tumor DNA (also abbreviated herein as "ctDNA"). A ZCS of the present disclosure can be used to target, enter, and/or accumulate in one or more cells and, e.g., target, enter, and/or accumulate in the nucleus of such cells. A ZCS can comprise an integration sequence which may also be derived from such ctDNA. These one or more cells that a recognition/targeting and integration sequence can be derived from can be of the same origin as the ctDNA used to produce such ZCS. For example, a DNA molecule that stems from and/or is derived from a nucleic acid molecule of a multiple myeloma (MM) cell can be used to target and/or deliver a cargo to a MM cell. Such an MM-derived ctDNA molecule can comprise one or more sequences that allow for MM cell recognition, cellular uptake, nuclear localization, and/or genomic (e.g., chromosomal) integration of the MM-derived targeting and integration sequences of this disclosure. In some instances, a targeting and an integration sequence can be part of a nucleic acid construct.

In some instances, the present disclosure provides delivery systems. Such delivery system can comprise any one or more of a (i) nucleic acid construct comprising one or more cell-targeting and one or more integration sequences (e.g., ZCSs); (ii) one or more cargo nucleic acid sequences that encode for therapeutic and/or diagnostic molecules, such as peptides or proteins; (iii) and one or more non-nucleic acid cargo molecules such as small molecules (e.g., therapeutic small molecules, dyes, etc.), proteins, peptides, or any combination thereof. Thus, the nucleic acid constructs of this disclosure may be particularly useful for the delivery of genes into cells in a highly specific manner, and in a way that is only minimally invasive due to the surprising finding that certain nucleic acid sequences, e.g., ZCSs, provide high targeting specificity on a cellular level (e.g., only cells of a certain origin, or cells of a certain genotype, tissue type, and/or organ type may be targeted), and integration sequences that allow for genomic integration and subsequent expression of a protein such as a therapeutic protein (e.g., tumor suppressors, apoptotic proteins, antigenic peptides, antibodies, enzymes, etc).

The present disclosure provides compositions and methods for the identification, characterization, isolation, synthesis, in vitro, and in vivo testing of cell- and tissue-type specific human cell-targeting nucleic acid constructs. In some instances, such nucleic acids comprise DNA molecules isolated from one or more regions of a tumor-cell(s) or tumor tissue(s). Such nucleic acid sequences (also referred herein as, Zip Code Sequences, ZCSs, or cell targeting signals) may be part of one or more transposons isolated from said tumor-cells. In some cases, a transposon sequence can be derived from ctDNA and can consist of or comprise such ZCS that can comprise a cell-targeting sequence and a genomic integration sequence. In other instances, a transposon herein can comprise or consist of a cell-targeting or a genomic integration sequence.

The present disclosure provides nucleic acid constructs that can comprise a cell-targeting and genomic integration sequence and that can circulate within a system such as an organisms, tolerate the activity of degradative enzymes (e.g., DNAses), and can exclusively, or almost exclusively (e.g., with at least 80%, 85%, 90%, 95%, 97%, or 99% specificity for a target cell, wherein such target cell is of the same or similar (e.g., the same organ or tissue type) than the cell that the cell-targeting and genomic integration sequence are derived from, and wherein such specificity is compared to a cell that is of different tissue or organ type. In an example, a MM-derived ZCS can target (and integrate) MM cells, a pancreatic cancer (PC)-derived ZCS can target (and integrate) PC cells, and so forth. Such recognition can be in vitro or in vivo and between cells of similar origin but different cell lines, e.g., a MM-derived recognition sequence can target and enter MM cells of different cell lines. In some cases, the nucleic acid constructs of the present disclosure can comprise portions or fragments of such ctDNA molecules. In some cases, the ctDNA molecules that nucleic acid constructs can be derived from may be obtained from a subject (e.g., a human subject). Such circulating tumor DNA fragments can comprise nucleic acid sequence that can have the ability to target certain cells or cell population and induce their integration into a cell's genome. In various instances, such nucleic acid sequence can be or can comprise a transposon (transposon sequence). In such instances, a nucleic acid construct herein can comprise one or more transposon sequences. Surprisingly, specific regions of these circulating tumor DNA fragments, also referred to herein as "zip codes," may be functioning as specific cell targeting signals and may be recognizing their specific cell(s) of origin, e.g., cells that "recognize" their zip code sequences. As an example, a ZCS of the disclosure derived from ctDNA that originated from a pancreatic cancer (PC) cell may have the ability to target PC cells with high specificity. Such zip code signals may be part of a specific "signature" of a given cell type (e.g., MM cells, PC cells, or any other cancer cell of other cell type). A nucleic acid construct of the present disclosure can comprise one or more ZCSs.

The Zip Code Sequences (ZCSs) of the present disclosure can target a certain cell with high specificity. A ZCS of the present disclosure can target, enter, and localize to the nucleus of a certain cell in the present of one or more other cells with a specificity that is greater than about 50%, 55%, 60%, 65%, 70,%, 75%, 80%, 85%, 90%, 91%, 92%, 93%, 94%, 95%, 96%, 97%, 98%, or greater than about 99%. As an example, a PC-specific ZCS targets, enters, and localizes to the nucleus of a PC cell at least 95%, 96%, 97%, 98%, or greater than about 99% specificity over other cells that may be present in the sample or in the organism (e.g., a rodent or a human).

Nucleic acid systems and constructs herein including a zip code sequence and integration sequence may enable cell and tissue specific cargo delivery (e.g. delivery of a cargo or nucleic acid construct such as a transgene), and thus may significantly reduce off-target and unwanted side effects, for example, as compared to conventional cargo delivery system (e.g., nanoparticles or viruses). The methods and compositions of the present disclosure are derived from sequences that were originally isolated and purified from endogenous biological mechanisms from cancer cells (e.g., circulating tumor DNA), and thus may not elicit a significant immune response. The methods and compositions of the present disclosure may enable applications of this technology in a variety of diseases including chronic, infectious, and immunological diseases.

The nucleic acid delivery systems of the present disclosure can comprise one or more cell/tissue-specific Zip Code Sequences that may depend on additional nucleic acid sequences to become integrated into the genome of a target cell. Hence, the human cell-targeting or zip code sequences may be directly used to direct a cargo to a specific cell in some instances, and in other instances they may be part of a larger construct that is engineered to become integrated into the genome of a target cell, e.g., by using an integration sequence. In some instances, the nucleic acid constructs of the present disclosure comprise a Zip Code recognition sequence that can allow for targeting of specific cells. Once inside the nucleus, the nucleic acid constructs of the present disclosure may allow for transposon-like integration of a cargo nucleic acid sequence via the integration sequence.

In some instances, the nucleic acid constructs of the present disclosure may include one or more guide nucleic acid sequences used to ensure insertion of the nucleic acid constructs at a specific insertion site within a genome of a cell. Nucleic acid delivery systems herein may comprise a nucleic acid construct, a promoter, and a gene of interest (e.g., a cargo nucleic acid encoding a therapeutic protein) which expression may be under regulatory control of said promoter. Utilizing the self-regulatory nature of the described system, the risk for random translocations and unwanted double stranded DNA breaks is expected to be significantly reduced over conventional, vector-based technologies.

In some cases, the nucleic acid constructs of the present disclosure may be used for diagnostic and monitoring purposes in various chronic, infectious or inherited (e.g., genetic) diseases, including cancer and certain disorders related to, for example, blood cells (e.g., anemia, thalassemia, hemophilia, or platelet disorders). In some cases, the presence of a cell and/or tissue specific recognition sequence as disclosed herein can be used as a biomarker for a particular disease or conditions and may be used to monitor response to a particular therapeutic intervention (e.g., chemotherapy, targeted therapy, immunotherapy, or cell and gene therapy). In other instances, a ZCS can be used as a companion diagnostic. In such instances, for example, the integration of a ZCS into a genome of a cell can be used as a measurement or marker to determine the degree of integration of a cargo nucleic acid sequence (e.g., a therapeutic gene sequence) into such genome. In other cases, cell targeting and genomic integration of a nucleic acid construct (or delivery system) described herein can be used as a marker for a particular biological effect. In an example, the degree of genomic integration of a therapeutic gene sequence can be proportional to the integration of a ZCS or transposon sequence of a delivery system and thus the amount of integrated material measured can be a marker or measurement for a therapeutic effect, e.g., cell killing.

In some cases, the nucleic acid constructs of the present disclosure may be used for the development of novel therapeutic strategies to prevent and treat diseases like cancer, inflammatory diseases, autoimmune diseases, etc. For instance, drug molecules that specifically target a cancer type-specific (e.g., pancreatic cancer-specific, multiple myeloma-specific, lung cancer-specific, etc.) ZCS or transposon may be designed to interrupt communication between tumor cells and thus reduce tumor heterogeneity, which may reduce the tumor's ability to develop resistance against therapeutic interventions. In another example, a nucleic acid constructs of the present disclosure can be used to elicit immune responses in a subject upon administration of the nucleic acid constructs. Such immune responses can be elicited by administering nucleic acid constructs that comprise a cargo nucleic acid sequence coding for one or more antigenic or immunogenic peptides or proteins, wherein, upon expression, such immunogenic peptides or proteins can elicit an immune response in the subject. Thus, in some cases, the ZCSs of the present disclosure can be used as vaccines, such as cancer vaccines.

In some aspects, the nucleic acid constructs of the present disclosure may be used as delivery vehicles for a variety of cargo (e.g., drug compounds). In some cases, the methods and compositions of the present disclosure may be used in combination with other modalities, such as nanoparticles to further enhance delivery.

In some aspects, the nucleic acid constructs of the present disclosure may be used for the therapy and/or diagnosis of a disease or conditions. In some cases, the nucleic acid constructs as described herein may be used to deliver therapeutic and/or diagnostic cargos to a specific cell, tissue, or organ of interest. For example, the Zip Code Sequences as described herein may be used to visualize and/or track a disease or condition (e.g., cancer) in vivo, e.g., by delivering a chemical dye (e.g., a fluorescent dye) or a radioactive isotope to one or more cells associated with the disease or conditions. In yet another example, tumor cells may be visualized and tracked in vivo by delivering a chemical dye (e.g., a fluorescent dye), a radioactive isotope, or contrast agents or the like to the tumor site(s) (e.g., primary tumor site and metastatic sites) with high specificity by using the Zip Code Sequences as described in the present disclosure.

In another aspect, the compositions and methods of the present disclosure may be used to treat a disease or condition (e.g., cancer) by causing genetic instability and subsequently cell death. For example, the nucleic acid sequences comprising one or more Zip Code Sequences can be engineered to cause genetic instability through insertion into a genome of a cell. In some cases, one or more nucleic acid constructs can be incorporated into a genome. In some cases, at least two nucleic acid constructs can be incorporated into a genome. In some cases, at least two nucleic acid constructs can be incorporated into a genome. In some cases, at least five nucleic acid constructs can be incorporated into a genome. In some cases, at least ten nucleic acid constructs can be incorporated into a genome. Thus, in some cases, the nucleic acid constructs of the present disclosure may be cytotoxic by themselves when, for example, their intracellular concentration is high enough to, for example, cause genetic instability when inserted into the cell's genome.

In some instances, one or more of the nucleic acid constructs as described herein can be taken up by a single cell. In some instances, at least two nucleic acid constructs as described herein can be taken up by a single cell. In some instances, at least five nucleic acid constructs as described herein can be taken up by a single cell. In some instances, at least ten nucleic acid constructs as described herein can be taken up by a single cell. In some instances, at least twenty nucleic acid constructs as described herein can be taken up by a single cell. In some instances, at least a hundred nucleic acid constructs as described herein can be taken up by a single cell.

In some cases, the nucleic acid constructs of the present disclosure may be cytotoxic through delivery of cytotoxic cargo to a cell, e.g. radioactive cargo. In some cases, radiolabeled nucleic acid constructs may cause DNA damage either from outside the cell (e.g., beta-radiation) or from within the cell (e.g., alpha-radiation).

Figure 12:
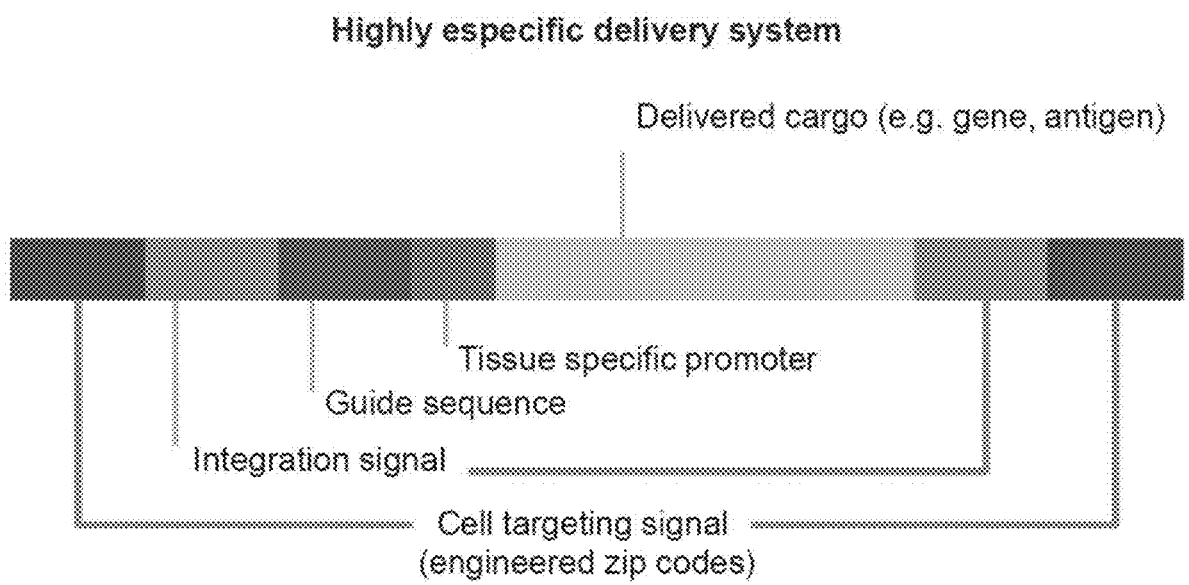
FIG. 12 is a depiction an example of a delivery system (e.g., for a gene or antigen of interest) as described herein comprising a zip code region (i.e., a cell targeting or cell recognition sequence(s)), an integration sequence(s) or integration region, a gene of interest encoding for a specific protein of interest, and, optionally, a guide sequence acting as an additional safety measure to ensure protein of interest is only expressed in the target cell population. The diagram illustrates that the cell targeting signal sequence(s) and the integration signal sequence(s) can be present at the 3' end or at the 5' end, or any combination thereof.

The present disclosure also provides synthetic nucleic acid Zip Code sequences that can be used in combination with the herein described methods and compositions. Such synthetic nucleic acid Zip Code sequences may be derived from ctDNA. Such synthetic nucleic acid Zip Code sequences (also abbreviated herein as "oligo ZCSs") may be part of a nucleic acid construct comprising one or more other nucleic acid sequences such as those coding for fluorescent proteins such as green fluorescent protein (GFP), red fluorescent protein (RFP), or luciferase, one or more promotor sequences, and/or one or more genes coding for e.g., therapeutic and/or diagnostic molecules, wherein the one or more genes may be under the regulatory control of said promotor(s). FIG. 12 schematically illustrates a nucleic acid construct of the present disclosure comprising two MM-specific, synthetic ZCSs that flank nucleic acid sequences coding for various proteins (e.g., GFP, luciferase, etc.).

Such synthetic oligo ZCSs can be form about 50 base pairs (bp) to about 1000 bp in length. An oligo ZCS can be from about 100 base pairs (bp) to about 900 bp in length. An oligo ZCS can be from about 200 bp to about 800 bp in length. An oligo ZCS can be from about 300 bp to about 700 bp in length. An oligo ZCS can be from about 400 bp to about 600 bp in length. An oligo ZCS can be at least about 100 bp in length. An oligo ZCS can be at least about 200 bp in length. An oligo ZCS can be at least about 300 bp in length. An oligo ZCS can be at least about 400 bp in length. An oligo ZCS can be at least about 500 bp in length. An oligo ZCS can be at least about 1000 bp in length.

As used herein, the terms "nucleic acid" and "polynucleotide" can be used interchangeably herein and generally refer to a polymeric form of nucleotides of any length, either ribonucleotides or deoxyribonucleotides. Polynucleotides include sequences of deoxyribonucleic acid (DNA), ribonucleic acid (RNA), or DNA copies of ribonucleic acid (cDNA). The term also refers to polynucleotide polymers that comprise chemically modified nucleotides. A polynucleotide can be formed of D-ribose sugars, which can be found in nature, and L-ribose sugars, which are not found in nature.

As used herein, the term "genome" generally refers to genomic information from a subject, which may be, for example, at least a portion or an entirety of a subject's hereditary information. A genome can be encoded either in DNA or in RNA. A genome can comprise coding regions (e.g., that code for proteins) as well as non-coding regions. A genome can include the sequence of all chromosomes together in an organism. For example, the human genome ordinarily has a total of 46 chromosomes. All these sequences together may constitute a human genome.

As used herein, a polynucleotide or polypeptide has a certain percent (%) "sequence identity" to another polynucleotide or polypeptide, meaning that, when aligned, that percentage of bases or amino acids are the same, and in the same relative position, when comparing the two sequences. Sequence identity can be determined in a number of different ways. To determine sequence identity, sequences can be aligned using various methods and computer programs (e.g., BLAST, T-COFFEE, MUSCLE, MAFFT, etc.).

As used herein, the term "nucleic acid system," "nucleic acid delivery system," and "nucleic acid construct" may be used interchangeably herein and generally refer to nucleic acid molecule-cargo conjugates or constructs comprising a nucleic acid molecule of the present disclosure that is associated with (e.g., covalently or non-covalently linked) a cargo moiety, which can be an additional nucleic acid molecule, a peptide or polypeptide, a detectable moiety (e.g., a fluorescent label), a small molecule moiety, or any combination thereof. The term may also refer to nucleic acid system used for gene therapy purposes, such as systems that comprise, for example, a zip code region, an integration region, a sequence encoding a gene of interest, and optionally a guide sequence.

As used herein, the term "cargo" generally refers to a molecule that can be coupled to a target-specific nucleic acid molecule of the present disclosure. Such cargo molecule can be a nucleic acid, protein, peptide, small molecule, radionuclide, polymer, or nanoparticle. Such cargo molecule can be covalently or non-covalently coupled to the target-specific nucleic acid. In some instances, a cargo herein can be a therapeutic molecule and can be referred to herein as "therapeutic cargo". Therapeutic molecules include nucleic acids with therapeutic functions, e.g., by causing apoptosis through insertion into a target cell genome, or by encoding for a therapeutic protein. Therapeutic cargos further include proteins such as antibodies, or functional binding fragments thereof, cytokines, signaling molecules, etc., and small molecules such kinase inhibitors or other anticancer drugs. In other instances, a cargo is a diagnostic molecule and can be referred to herein as "diagnostic cargo". Such diagnostic cargo can be a fluorophore, a radionuclide, a contrast agent, etc.

Figure 20:
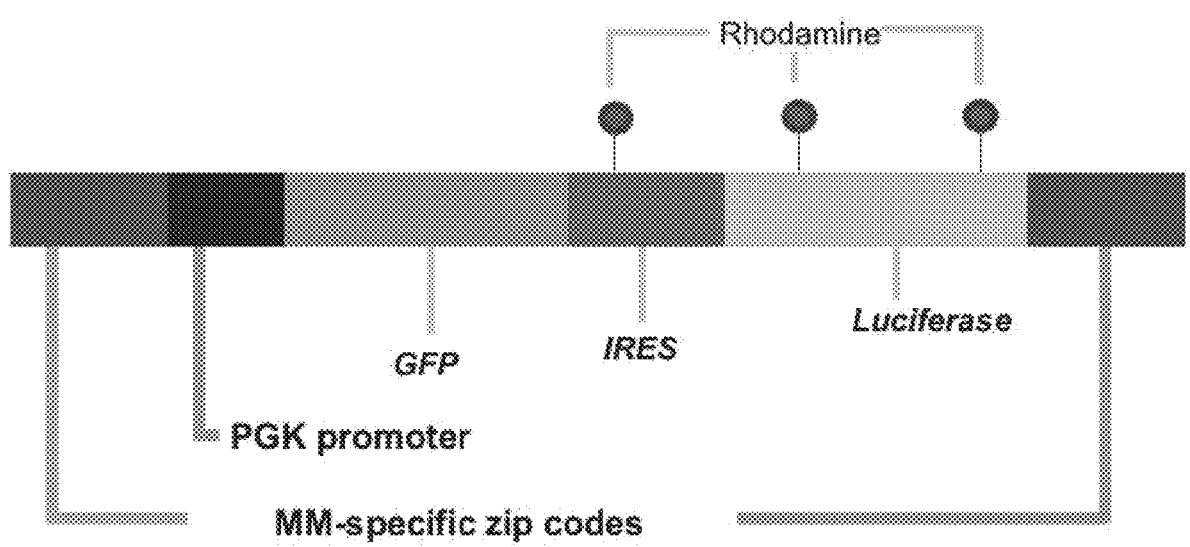
FIG. 20 schematically illustrates a synthesized MM-specific Zip Code oligonucleotide construct of the present disclosure. Such a construct can comprise two Zip Code sequences (e.g., about 300 bp in length) that flank, on either site, a construct comprising a translation element (e.g., IRES), a GFP-coding sequence, a promotor, a luciferase-coding sequence, and one or more rhodamine dye molecules that may be distributed along the construct, and may be used for tracking movement of the construct (or fragments thereof) in vitro and/or in vivo.

As used herein, the term "coupled to" generally refers to covalently of non-covalently attaching a first molecule to a second molecule. In various instances herein, one or more molecule can be coupled to one another. In an example, a nucleic acid construct of this disclosure can comprise a first DNA sequence (e.g., a cell targeting sequence) and a second DNA sequence (e.g., a genomic integration sequence), wherein the first DNA sequence can be covalently coupled to the second DNA sequence via phosphodiester bonds. In another example, a delivery system herein can comprise a nucleic acid construct for cell targeting and genomic integration as well as one or more other nucleic acid sequences such as a therapeutic gene sequence coding for a therapeutic protein, a promoter sequence that can regulate expression of such gene sequence, and other suitable nucleic acid sequence. In some instances, the one or more different nucleic acid portions (e.g., nucleic acid constructs, gene sequence, promoter, etc.) of such delivery system can be covalently coupled to form a linear nucleic acid molecule. FIG. 12 illustrates an example of such linear delivery system. Such linear delivery can have one or more additional cargo molecule coupled to it, either covalently or non-covalently. FIG. 20 illustrates an example of such delivery system where a linear nucleic acid sequence comprising various portions (e.g., nucleic acid constructs sequence, gene sequence, promoter, etc.) has one or more cargo molecules (in this case, fluorescent dyes) coupled to it. Such one or more cargo molecules can be coupled to the nucleic acid sequence along the length of such sequence (e.g., as depicted in FIG. 20), and/or at the 3' and/or 5' ends (termini) of such nucleic acid sequence.

As used herein, the term "cell type" generally refers to a classification used to distinguish between morphologically or phenotypically distinct cell forms within a genus or a species. A multicellular organism may contain a number of widely differing and specialized cell types, such as pancreatic cells, lung cells, muscle cells and skin cells in humans that differ both in appearance and function yet are genetically identical. Cells are able to be of the same genotype, but different cell type due to the differential regulation of the genes they contain. Classification of a specific cell type is can be done through the use of microscopy, cell surface markers, functionality, or another suitable method.

The term "about," as used herein in the context of a numerical value or range, generally refers to +10% of the numerical value or range recited or claimed, unless otherwise specified.

Whenever the term "at least," "greater than," or "greater than or equal to" precedes the first numerical value in a series of two or more numerical values, the term "at least," "greater than" or "greater than or equal to" applies to each of the numerical values in that series of numerical values. For example, greater than or equal to 1, 2, or 3 is equivalent to greater than or equal to 1, greater than or equal to 2, or greater than or equal to 3.

Whenever the term "no more than," "less than," or "less than or equal to" precedes the first numerical value in a series of two or more numerical values, the term "no more than," "less than," or "less than or equal to" applies to each of the numerical values in that series of numerical values. For example, less than or equal to 3, 2, or 1 is equivalent to less than or equal to 3, less than or equal to 2, or less than or equal to 1.

The term "pharmaceutically acceptable salt" generally refers to physiologically and pharmaceutically acceptable salt of a compound of the disclosure: e.g., salt that retains the biological activity of the parent compound and does not impart toxicological effects thereto. For oligomers, examples of pharmaceutically acceptable salts and their uses are further described in U.S. Pat. No. 6,287,860, which is hereby incorporated by reference in its entirety.

The term "subject," as used herein, generally refers to a living member of the animal kingdom. The subject may be suffering from or may be suspected of suffering from a disease or disorder. The subject can be a member of a species comprising individuals who naturally suffer from the disease. The subject can be a mammal. Non-limiting examples of mammals can include rodents (e.g., mice and rats), primates (e.g., lemurs, monkeys, apes, and humans), rabbits, dogs (e.g., companion dogs, service dogs, or work dogs such as police dogs, military dogs, race dogs, or show dogs), horses (such as race horses and work horses), cats (e.g., domesticated cats), livestock (such as pigs, bovines, donkeys, mules, bison, goats, camels, and sheep), and deer. The subject can be a human. The subject can be anon-mammalian animal such as a turkey, a duck, or a chicken. The subject can be a farm animal (e.g., pig, goat or cow). The subject can be a living organism suffering from or prone to a disease or condition that can be diagnosed and/or treated using the kits, methods, and systems as provided herein. The subject may be a patient being treated or monitored by a healthcare provider (e.g., a primary care physician). Alternatively, the subject may not be a patient.

The term "diagnosis," as used herein, generally refers to a relative probability that a disease (e.g., an autoimmune, inflammatory autoimmune, cancer, infectious, immune, dysbiosis, etc.) can be present in a subject. Similarly, the term "prognosis" generally refers to a relative probability that a certain future outcome may occur in the subject with respect to a disease state.

The term "substantially the same," as used herein in the context of a tissue tropic nucleic acid means similar or identical in function or capability, unless otherwise specified.

Cell- and Tissue-Type Specific Tumor Recognition Nucleic Acid Sequences (i.e., Zip Code Sequences or ZCSs)

The present disclosure provides compositions and methods for the cell-, tissue-, and/or organ-specific targeting, uptake, and/or nuclear localization of molecules (e.g., nucleic acid molecules). Such molecules may comprise nucleic acid sequences such as Zip Code Sequences (ZCSs). Such ZCSs can target, enter, and localize to the nucleus of cancer cells. A cancer cell-specific ZCS of the present disclosure can be derived from ctDNA. The ctDNA can originate from a cancer cell. The cancer cell may be of any type of cancer (e.g., blood cancer, cancer that originated in the bone marrow, solid tumor, etc.), including but not limited to multiple myeloma, lymphoma, leukemia, pancreatic cancer, lung cancer, colon cancer (e.g., colorectal cancer) or brain cancer. Thus, the herein described nucleic acid constructs comprising such one or more ZCSs can be used as specific targeting and delivery constructs and/or targeting and delivery vehicles for various cargo, e.g., nucleic acid sequences (such as genes coding for as therapeutic and/or diagnostic molecules).

A ZCS of the disclosure can comprise one or more cell- and/or tissue-type specific tumor cell recognition and/or chromosomal integration sequences. These sequences can enable a ZCS to recognize a cell in a cell-specific manner. For example, a PC-specific ZCS can comprise one or more PC-specific recognition and/or integration sequences (also referred to herein as "recognition signals" and "integration signals," respectively) that may allow the PC-specific ZCS to target, enter accumulate, and/or localize to a nucleus of PC cells with high specificity (e.g., >95% specificity).

A cell-specific ZCS of the disclosure may exhibit high cell specificity even in the presence of ZCSs with specificity for the same and/or other cells or cell types. For example, a PC-specific ZCS can show high uptake, accumulation, localization to the nucleus of, and integration into the chromosome of a PC cell in the presence of MM-specific ZCS (see e.g., FIGS. 17A-17D).

In some instances, the disclosure provides a compositions, such as a pharmaceutical composition, comprising an isolated nucleic acid molecule comprising a nucleotide sequence having at least 70%, at least 80%, at least 90%, at least 95%, or at least 99% sequence identity to any one or more of SEQ ID NO: 1-SEQ ID NO: 277, or at least 70%, at least 80%, at least 90%, at least 95%, or at least 99% sequence identity to a fragment thereof. In some cases, the isolated nucleic acid sequence can be at least 200 base pairs in length. In some cases, the isolated nucleic acid sequence can be at least 400 base pairs in length. In some instances, said nucleic acid sequence can range from about 200 base pairs to about 800 base pairs in length. In some instances, said nucleic acid sequence can range from about 400 base pairs to about 2,000 base pairs in length. In some instances, said nucleic acid sequence can range from about 400 base pairs to about 5,000 base pairs in length. In some instances, said nucleic acid sequence can range from about 1,500 base pairs to about 7,200 base pairs in length. In some instances, said nucleic acid sequence can range from about 1,900 base pairs to about 5,800 base pairs in length. In some instances, said nucleic acid sequence can range from about 2,000 base pairs to about 10,000 base pairs in length. In some instances, said nucleic acid sequence can range from about 5,000 base pairs to about 15,000 base pairs in length. In some instances, said nucleic acid sequence can range from about 600 base pairs to about 16,900 base pairs in length. In some instances, said nucleic acid sequence can range from about 8,000 base pairs to about 18,000 base pairs in length. In some instances, said nucleic acid sequence can range from about 10,000 base pairs to about 20,000 base pairs in length. In some instances, said nucleic acid sequence can range from about 400 base pairs to about 20,000 base pairs in length.

In some instances, the disclosure provides a composition comprising an isolated nucleic acid with a sequence that has at least 70%, at least 80%, at least 90%, at least 95%, or at least 95% identity to SEQ ID NO: 1-SEQ ID NO: 277, or SEQ ID NO: 282, that contains at least one nucleobase substitution modification relative to SEQ ID NO: 1-SEQ ID NO: 277, or SEQ ID NO: 282. In some cases, an isolated nucleic acid sequence of the present disclosure can comprise at least 10 nucleobase substitution modifications relative to SEQ ID NO: 1-SEQ ID NO: 277, or SEQ ID NO: 282. In some cases, an isolated nucleic acid sequence of the present disclosure can comprise at least 50 nucleobase substitution modifications relative to SEQ ID NO: 1-SEQ ID NO: 277, or SEQ ID NO: 282. In some cases, an isolated nucleic acid sequence of the present disclosure can comprise at least 100 nucleobase substitution modifications relative to SEQ ID NO: 1-SEQ ID NO: 277, or SEQ ID NO: 282. In some cases, an isolated nucleic acid sequence of the present disclosure can comprise at least 250 nucleobase substitution modifications relative to SEQ ID NO: 1-SEQ ID NO: 277, or SEQ ID NO: 282. In some cases, an isolated nucleic acid sequence of the present disclosure can comprise from about 1 to about 20 nucleobase substitution modifications relative to SEQ ID NO: 1-SEQ ID NO: 277, or SEQ ID NO: 282. In some cases, an isolated nucleic acid sequence of the present disclosure can comprise from about 20 to about 100 nucleobase substitution modifications relative to SEQ ID NO: 1-SEQ ID NO: 277, or SEQ ID NO: 282. In some cases, an isolated nucleic acid sequence of the present disclosure can comprise from about 50 to about 250 nucleobase substitution modifications relative to SEQ ID NO: 1-SEQ ID NO: 277, or SEQ ID NO: 282. In some cases, an isolated nucleic acid sequence of the present disclosure can comprise from about 150 to about 500 nucleobase substitution modifications relative to SEQ ID NO: 1-SEQ ID NO: 277, or SEQ ID NO: 282. In some cases, an isolated nucleic acid sequence of the present disclosure can comprise from about 250 to about 700 nucleobase substitution modifications relative to SEQ ID NO: 1-SEQ ID NO: 277, or SEQ ID NO:

282. In some cases, an isolated nucleic acid sequence of the present disclosure can comprise from about 500 to about 750 nucleobase substitution modifications relative to SEQ ID NO: 1-SEQ ID NO: 277, or SEQ ID NO: 282. In some cases, an isolated nucleic acid sequence of the present disclosure can comprise from about 500 to about 1,000 nucleobase substitution modifications relative to SEQ ID NO: 1-SEQ ID NO: 277, or SEQ ID NO: 282.

In some instances, the nucleic acid constructs and systems of the present disclosure can comprise at least one detectable moiety (e.g., a fluorescent label or a radioactive label) that is attached (e.g., covalently linked or conjugated) to the nucleic acid. In such cases, the detectable moiety can be linked to the 3' or 5' end of the nucleic acid, or any suitable combination thereof. The detectable moiety may include a fluorophore, such as a fluorescent dye or a quantum dot. In some cases, a detectable moiety may comprise a small molecule (e.g., a fluorescent dye), whereas in other cases a detectable moiety may comprise a fluorescently labeled polypeptide, a fluorescently labeled nucleic acid probe, and/or a fluorescently labeled polypeptide complex. In some cases, the detectable moiety can be any dye molecule, such as a Quasar Dye (e.g., Q570 and Q670). The detection agent or moiety may also be an unlabeled probe which can be further conjugated to an additional labeled probe (e.g., a labeled polypeptide or antibody). In some cases, for example, a detectable moiety may be indirectly conjugated or bound to the nucleic acid by a conjugating moiety. As described herein, a detectable moiety may be a small molecule (e.g., a dye) which may be directly conjugated or bound to the nucleic acid. A detectable moiety may be a fluorescently labeled protein or molecule which may be attached to a conjugating moiety (e.g., a hapten group, an azido group, an alkyne group, or tetrazine) of the nucleic acid, using, for example, click chemistry.

In some cases, a fluorescent small molecule as described herein may comprise rhodamine, rhodol, fluorescein, thiofluorescein, aminofluorescein, carboxyfluorescein, chlorofluorescein, methylfluorescein, sulfofluorescein, aminorhodol, carboxyrhodol, chlororhodol, methylrhodol, sulforhodol; aminorhodamine, carboxyrhodamine, chlororhodamine, methylrhodamine, sulforhodamine, thiorhodamine, cyanine, indocarbocyanine, oxacarbocyanine, thiacarbocyanine, merocyanine, cyanine 2, cyanine 3, cyanine 3.5, cyanine 5, cyanine 5.5, cyanine 7, oxadiazole derivatives, pyridyloxazole, nitrobenzoxadiazole, benzoxadiazole, pyren derivatives, cascade blue, oxazine derivatives, Nile red, Nile blue, cresyl violet, oxazine 170, acridine derivatives, proflavin, acridine orange, acridine yellow, arylmethine derivatives, auramine, crystal violet, malachite green, tetrapyrrole derivatives, porphin, phtalocyanine, bilirubin 1-dimethylaminonaphthyl-5-sulfonate, 1-anilino-8-naphthalene sulfonate, 2-p-touidinyl-6-naphthalene sulfonate, 3-phenyl-7-isocyanatocoumarin, N-(p-(2-benzoxazolyl)phenyl)maleimide, stilbenes, pyrenes, 6-FAM (Fluorescein), 6-FAM (NHS Ester), 5(6)-FAM, 5-FAM, Fluorescein dT, 5-TAMRA-cadavarine, 2-aminoacridone, HEX, JOE (NHS Ester), MAX, TET, ROX, TAMRA, TARMA™ (NHS Ester), TEX 615, ATTO™ 488, ATTO™ 532, ATTO™ 550, ATTO™ 565, ATTO™ Rho101, ATTO™ 590, ATTO™ 633, ATTO™ 647N, TYE™ 563, TYE™ 665, or TYE™ 705.

A fluorescent moiety may comprise Cy3, Cy5, Cy5.5, Cy7, Q570, Alexa488, Alexa555, Alexa594, Alexa647, Alexa680, Alexa 750, Alexa 790, Atto488, Atto532, Atto647N, TexasRed, CF610, Propidium iodide, Quasar 570 (Q570), Quasar 670 (Q670), IRDye700, IRDye800, Indocyanine green, Pacific Blue dye, Pacific Green dye, or Pacific Orange dye.

In some cases, a fluorescent moiety may comprise a quantum dot (QD). Quantum dots may be a nanoscale semiconducting photoluminescent material. Exemplary QDs may include, but are not limited to, CdS quantum dots, CdSe quantum dots, CdSe/CdS core/shell quantum dots, CdSe/ZnS core/shell quantum dots, CdTe quantum dots, PbS quantum dots, and/or PbSe quantum dots. As used herein, CdSe/ZnS may mean that a ZnS shell is coated on a CdSe core surface (a "core-shell" quantum dot). The shell materials of core-shell QDs may have a higher bandgap and passivate the core QDs surfaces, resulting in higher quantum yield and higher stability and wider applications than core QDs. A quantum dot provided herein may include QDot525, QDot 545, QDot 565, QDot 585, QDot 605, or QDot 655. In some cases, a nucleic acid as described herein may comprise a quantum dot such as QDot525, QDot 545, QDot 565, QDot 585, QDot 605, or QDot 655. A probe described herein may comprise QDot525. A probe described herein may comprise QDot 545. A probe described herein may comprise QDot 565. A probe described herein may comprise QDot 585. A probe described herein may comprise QDot 605. A probe described herein may comprise QDot 655.

In some cases, the nucleic acid may include a conjugating moiety. The conjugation moiety may be attached at the 5' terminus, the 3' terminus, or at an internal site along the length of the nucleic acid. The conjugating moiety may be a nucleotide analog (such as bromodeoxyuridine). The conjugating moiety may be a conjugating functional group. The conjugating functional group may be an azido group or an alkyne group. The probe may further be derivatized through a chemical reaction such as click chemistry or any other bioconjugation reaction. The click chemistry may be a copper(I)-catalyzed [3+2]-Huisgen 1,3-dipolar cyclo-addition of alkynes and azides leading to 1,2,3-triazoles. The click chemistry may be a copper free variant of the above reaction. The click chemistry may be an inverse electron-demand Diels-Alder reaction between a trans-cyclooctadiene and a tetrazine.

In some cases, the conjugating moiety as used herein may comprise a hapten group. A hapten group may include digoxigenin, 2,4-dinitrophenyl, biotin, avidin, or are selected from azoles, nitroaryl compounds, benzofurazans, triterpenes, ureas, thioureas, rotenones, oxazoles, thiazoles, coumarins, cyclolignans, heterobiaryl compounds, azoaryl compounds or benzodiazepines. A hapten group may include biotin. The nucleic acid comprising the conjugating moiety may further be linked to a second nucleic acid, a fluorescent moiety (such as a dye such as a quantum dot), or a conjugating partner such as a polymer (such as PEG), a macromolecule (such as a carbohydrate, a lipid, a polypeptide), and the like.

In some aspects, a detectable label or moiety as described herein may be detected by light microscopy, fluorescence microscopy, or chromatography. Detection of the detectable label of a probe may comprise stimulating the probe or a portion thereof (such as the detectable label) with a source of radiation (such as a light source, such as a laser). Detection of the detectable label of a probe may also comprise an enzymatic reaction.

In some cases, the detectable label can be a radioactive label (e.g., a radioactive isotope) that enables the visualization of distribution of the herein disclosed nucleic acid constructs via positron emission tomography (PET) or single photon emission computed tomography (SPECT). Those nuclear detection methodologies may be coupled with computed X-ray tomography (CT) (e.g., PET/CT or SPECT/CT). In some cases, a detectable moiety can comprise a radioactive isotope of at least one element. Exemplary suitable radiolabels include but are not limited to those described herein. In some cases, radioisotopes comprise $^{99m}$Tc, $^{111}$In, $^{64}$Cu, $^{67}$G, $^{186}$Re, $^{188}$Re, $^{153}$Sm, $^{177}$Lu, $^{67}$Cu, $^{123}$I, $^{124}$I, $^{125}$I, $^{11}$C, $^{13}$N, $^{15}$O, $^{18}$F, $^{186}$Re, $^{188}$Re, $^{153}$Sm, $^{166}$Ho $^{177}$, Lu$^{149}$Pm, $^{90}$Y, $^{213}$Bi, $^{103}$Pd, $^{109}$Pd, $^{159}$Gd, $^{140}$La, $^{198}$Au, $^{199}$Au, $^{169}$Yb, $^{175}$Yb, $^{165}$Dy, $^{166}$Dy, $^{67}$Cu, $^{105}$Rh $^{111}$Ag, $^{89}$Zr, $^{225}$Ac, and $^{192}$Ir.

In some aspects of the present disclosure, the radioactive isotope can be attached to a nucleic acid molecule as described herein using a chelator. Exemplary chelator moieties may include 2,2',2"-(3-(4-(3-(1-(4-(1,2,4,5-tetrazin-3-yl)phenyl)-1-oxo-5,8,11,14,17,20,23-heptaoxa-2-azapentacosan-25-yl)thioureido)benzyl)-1,4,7-triazonane-2,5,8-triyl) triacetic acid; 2,2',2"-(3-(4-(3-(1-(4-(1,2,4,5-tetrazin-3-yl) phenyl)-1-oxo-5,8,11,14,17,20,23,26,29,32,35-undecaoxa-2-azaheptatriacontan-37-yl)thioureido)benzyl)-1,4,7-triazonane-2,5,8-triyl)triacetic acid; 2,2'-(7-(4-(3-(1-(4-(1,2,4,5-tetrazin-3-yl)phenyl)-1-oxo-5,8,11,14,17,20,23,26,29,32,35-undecaoxa-2-azaheptatriacontan-37-yl)thioureido) benzyl)-1,4,7-triazonane-1,4-diyl)diacetic acid; 2,2',2"-(3-(4-(3-(1-(4-(1,2,4,5-tetrazin-3-yl)phenyl)-3,7-dioxo-11,14,17,20,23,26,29-heptaoxa-2,8-diazahentriacontan-31-yl) thioureido)benzyl)-1,4,7-triazonane-2,5,8-triyl)triacetic acid; 2,2,2"-(3-(4-(3-(1-(4-(1,2,4,5-tetrazin-3-yl)phenyl)-3,7-dioxo-11,14,17,20,23,26,29,32,35,38,41-undecaoxa-2,8-diazatritetracontan-43-yl)thioureido)benzyl)-1,4,7-triazonane-2,5,8-triyl)triacetic acid; 2,2',2"-(3-(4-(3-(25,28-dioxo-28-((6-(6-(pyridin-2-yl)-1,2,4,5-tetrazin-3-yl) pyridin-3-yl)amino)-3,6,9,12,15,18,21-heptaoxa-24-azaoctacosyl)thioureido)benzyl)-1,4,7-tnazonane-2,5,8-triyl)triacetic acid; 2,2',2"-(3-(4-(3-(37,40-dioxo-40-((6-(6-(pyridin-2-yl)-1,2,4,5-tetrazin-3-yl)pyridin-3-yl)amino)-3,6,9,12,15,18,21,24,27,30,33-undecaoxa-36-azatetracontyl) thioureido)benzyl)-1,4,7-triazonane-2,5,8-triyl)triacetic acid; 2,2' 2"-(3-(4-(1-(4-(6-methyl-1,2,4,5-tetrazin-3-yl) phenyl)-3-oxo-6,9,12,15,18,21,24-heptaoxa-2-azaheptacosan-27-amido)benzyl)-1,4,7-triazonane-2,5,8-triyl)triacetic acid; 2,2,2"-(2-(4-(1-(4-(6-methyl-1,2,4,5-tetrazin-3-yl)phenoxy)-3,6,9,12,15,18,21,24,27,30,33-undecaoxahexatriacontan-36-amido)benzyl)-1,4,7-triazonane-1,4,7-triyl)triacetic acid; 2,2,2"-(3-(4-(3-(5-amino-6-((4-(6-methyl-1,2,4,5-tetrazin-3-yl)benzyl)amino)-6-oxohexyl)thioureido)benzyl)-1,4,7-triazonane-2,5,8-triyl) triacetic acid; 2,2'-(7-(4-(3-(5-amino-6-((4-6-methyl-1,2,4,5-tetrazin-3-yl)benzyl)amino)-6-oxohexyl)thioureido) benzyl)-1,4,7-triazonane-1,4-diyl)diacetic acid; 2,2',2"-(3-(4-(3-(5-amino-6-((5-amino-6-((4-(6-methyl-1,2,4,5-tetrazin-3-yl)benzyl)amino)-6-oxohexyl)amino)-6-oxohexyl)thioureido)benzyl)-1,4,7-triazonane-2,5,8-triyl) triacetic acid; and 2,2',2"-(3-(4-(3-(5-amino-6-((5-amino-6-((5-amino-6-((4-(6-methyl-1,2,4,5-tetrazin-3-yl)benzyl) amino)-6-oxohexyl)amino)-6-oxohexyl)amino)-6-oxohexyl)thioureido)benzyl)-1,4,7-triazonane-2,5,8-triyl) triacetic acid.

In some cases, the nucleic acid molecules of the present disclosure may be associated (e.g., conjugated or covalently linked) with particles (e.g., nanoparticles) or vesicles (e.g., exosomes) for cell and/or tissue specific targeting. For instance, cargo-containing nanoparticles or exosomes can be functionalized with cell-targeting nucleic acid molecules on their surface enabling highly specific cargo delivery.

In some instances, the disclosure provides a vector comprising an isolated nucleic acid comprising a sequence that has at least 70%, at least 80%, at least 90%, at least 95%, or at least 95% identity to SEQ ID NO: 1-SEQ ID NO: 277, or SEQ ID NO: 282, and a heterologous nucleic acid sequence. In some instances, the heterologous sequence further comprises an integration signal. In some instances, the heterologous sequence further comprises a sequence encoding a gene of interest, such as a sequence encoding an immunogen or a sequence encoding a protein that can be expressed from the genome. Such protein sequences can be under the control of a tissue selective promoter, to further promote tissue specific expression of the protein.

In some aspects of the present disclosure, the nucleic acid sequences and systems as described herein can comprise various portions that can be associated with a particular function. For example, a system of the present disclosure can be a nucleic acid delivery system for a gene of interest (e.g., a transgene) comprising a cell targeting signal, an integration signal, a guide sequence, and a portion that encodes a gene of interest. Optionally, the delivery constructs of the present disclosure may comprise barcode sequences (e.g., PACbio sequences) at one or both ends to identify the 3'- and 5'-ends of the nucleic acid sequences. The diagram in FIG. 12, for example, illustrates that a cell targeting signal sequence can be present at the 3' end and at the 5' end of a nuclei acid delivery system described herein. The construct may also include an integration signal sequence and the presence of such integration signal sequences can facilitate integration of such nucleic acid sequence, or at least a portion thereof, into the genome. In some cases, a ZCS or transposon as described herein comprises a cell targeting sequence and an integration sequence. In some cases, a delivery system of the present disclosure can comprise at least one additional sequence at both ends of the gene of interest and thus flanking the gene of interest on both sites, such as for example, ZCSs or transposons as shown in FIG. 12 and FIG. 20.

In some embodiments of this disclosure, a ZCS can consist of or can comprise one or more transposons, such as class II transposons. In such instances, a transposon can be any molecule capable of targeting a certain cell, cell population, or tissue (e.g., blood cells, lung tissue, pancreatic tissue, colonic tissue, etc.), and/or integrating itself and/or an additional cargo nucleic acid molecule into a genome of the target cell. In some instance, the transposon is nucleic acid. Such nucleic acid can comprise or consist of DNA. In instances where a transposon of this disclosure is a DNA sequence, the transposon can comprise a nucleotide sequence having at least about 80%, 85%, 90%, 95%, 97%, 99%, or 100% sequence identity any one of SEQ ID NO: 203-SEQ ID NO: 277 or SEQ ID NO: 282, or at least about 80%, 85%, 90%, 95%, 97%, 99%, or 100% sequence identity to a fragment thereof. Such fragment can be at least about 8, 10, 12, 15, 20, 25, or 30 nucleotides in length. In some embodiments, a transposon can comprise or consist of a nucleotide sequence of any one of SEQ ID NO: 203-SEQ ID NO: 277 or SEQ ID NO: 282 (ACCCGGCCTTGGACACGCCATTTT-CAACTCCGTGGTGCGTTTTTTTTTTTTTTTT TTTTTTTGTAATGGAGTTTTGCTCTTGTTGCCCAG-GATGGAGTGCAAGGGATCTTG GCTCAC-CACAGCCTCTGCCTCCTGGGTTCAAGTGAT-TCTTCTGCCTCAGCCTCCCA AGTAGCTGGGATTATAAGCACCCACCAC-CACGCCCAGCTAATTTTGTATTTTTA GAAGAGATGGAGTTTCTCCAGTTGGCCAG-GATGGTCTGTATATCCTGACCTCATG ATCTGCC-CACCA, SEQ ID NO: 282). In an example, a nucleic acid constructs consisting of or comprising a nucleic acid sequence set forth in SEQ ID NO: 282 can target multiple myeloma (MM) cell in a highly selective manner compared to cells of other origins or tissues and can integrate into a genome of the MM cell. Such nucleic acid construct can be used to direct a cargo molecule to MM cells.

In some cases, a delivery system of the disclosure can comprise at least two, at least three, at least four, at least five, or another suitable number of cell-targeting sequences at either the 3' or the 5' end of a nucleic acid delivery system. A composition of the disclosure can comprise a plurality of such delivery systems, and each delivery system can target one or more cell type. Thus, the methods and compositions of the present disclosure can be used to target one or more different target cells, one or more different target cell population, and/or one or more different target tissues simultaneously.

In some cases, one portion (e.g., half) of a sequence can be linked to the 5' end of a gene of interest and the other portion (e.g., half) of the sequence can be linked 3' end of the gene of interest. In some cases, a sequence can be linked directly or indirectly to a gene of interest. For example, in some cases, a first sequence can be linked directly to the 5' end of a nucleic acid sequence comprising the gene of interest, and a second sequence can be linked indirectly to the 3' end of the nucleic acid sequence comprising the gene of interest. In some cases, a composition of the present disclosure can comprise a guide sequence that is directly linked to a gene of interest at one terminus (e.g., 3' end) and directly linked to a ZCS or transposon sequence at the other terminus (e.g., 5' end), and thus indirectly connecting the transposon or ZCS sequence and the gene of interest (see e.g., FIG. 12, FIG. 20).

In some cases, the cell targeting signal sequence and the integration signal sequence are cell- and/or tissue-specific, thus allowing expression of a gene of interest in one or more target cell populations and/or in one or more target tissues. In some cases, a nucleic acid system of the disclosure further comprises a nucleic acid sequence that encodes a gene of interest. The gene of interest may encode for a ribonucleic acid (i.e., mRNA) that is used by a cell in the translation of a polypeptide or a protein. In other words, the gene of interest may encode a heterologous protein or polypeptide.

In further instances, the present disclosure provides nucleic acid constructs and nucleic acid delivery systems that can comprise one or more guide nucleic acid sequences. Such guide nucleic acids can be integration signal sequences, guide-RNA, guide-DNA, or a combination thereof. Such guide nucleic acid sequences can be used, for instance, to direct such construct or delivery system to a specific location within a genome of a cell for genomic integration. Thus, in some instances, guide nucleic acid sequences herein can be used to select specific site of integration within a genome of a cell (e.g., a cancer cell).

The gene of interest can encode a protein or polypeptide that performs a particular function. For example, the gene of interest may encode a protein or polypeptide that is not being produced by the cell. A gene of interest may encode a therapeutic protein that can be further used as an antigen for therapeutic treatment. Alternatively, a gene of interest may encode a therapeutic protein that can be used in gene therapy. Such therapeutic proteins can reduce, prevent, and/or eliminate the growth and/or survival of a cell targeted by the nucleic acid systems of the disclosure. Such cells can be cancer cells. The target cell may be associated with a disease or condition, and target cell-specific expression of the gene of interest can be achieved by using Zip Code Sequences as described herein.

In some cases, a delivery system of the disclosure can comprise at least two, at least three, at least four, at least five, or another suitable number of sequences encoding a gene of interest.

In some instances, the integration of a gene of interest may be locus-specific or non-locus-specific. In some aspects of the present disclosure, a gene of interest can be expressed in a cell, and the resulting endogenous or exogenous therapeutic protein can be retained within the cell. In yet another aspect, the therapeutic protein of this invention can be released from the cell. In some cases, the rate with which the gene of interest can be expressed can vary depending on which promoter used, and/or whether the gene of interest is integrated into the genome of a target cell in a locus-specific manner. For some application, it may be desirable to express a protein from a constitutive promoter. In other instances, it may be desirable to express the protein from an inducible promoter.

In some aspects of the present disclosure, the gene of interest can encode an endogenous protein or functional RNA molecule that is either lacking or functionally impaired in a subject. In some instances, a subject carrying a mutation in a gene, such as cancerous mutation can be treated with this invention by supplying the lacking or functionally impaired protein.

In some aspects, the compositions and methods of the present disclosure may be used for cell-, tissue-, or organ-specific delivery of molecules that may carry out a specific function within a cell. For example, in some cases the nucleic acid constructs of the present disclosure may be used to deliver a certain gene of interest which encodes a protein that exhibits a certain function. In yet another example, the compositions as described herein may be used to inactivate a certain target gene. For instance, the compositions as described herein may be used to deliver interfering RNA such as small hairpin RNAs (shRNAs) to a target cell, which may be used for silencing that target gene via RNA interference (RNAi).

In some cases, a cargo may be a nucleic acid. Such nucleic acid can be a gene of interest. Such gene of interest may encode for one or more proteins that can exhibit a certain function and cause a specific biological effect, such as a therapeutic effect. In some cases, a cargo may be, or a transgene to be delivered into a target cell may encode for, Keratin 7, human Cholecystokinin A receptor (Ductal pancreatic cells origin of pancreatic cancer), human epididymis protein 4 (HE4, ovarian cancer), GATA2 and WASP (hematopoietic stem cells), Prostate-specific antigen, GFAB (Astrocytes), CD20 and CD19 (B lymphocytes), In some cases, a gene of interest may encode for HER2, HER3, CD20, VEGF, EGF, CD38, SLAM7, CD52, CD30, CD19, CD3, PD1, or PDL1. In some cases, a gene of interest as disclosed herein may encode for a nuclear factor-kappaB (NF-kappaB), or a p53 (e.g., wild-type p53 or super repressor p53), or any combination thereof. In some cases, a gene of interest as disclosed herein may encode for bacterial antigens such as those derived from Respiratory syncytial virus (RSV, e.g., RSV-A and RSV-B), Hepatitis C Virus (HCV), Dengue Virus (DENV), Herpes simplex virus types 1 (HSV-1) and 2 (HSV-2), Human papillomaviruses (HPVs), or influenza-derived antigens including Hemagglutinin fusion peptide (HA-fp) epitope, Hemagglutinin hydrophobic pocket peptide (HA-hp) epitope, Hemagglutinin helix A epitopes, Neuraminidase epitopes, M2 ectodomain (M2e) epitopes, and nucleoprotein (NP) epitopes.

In some cases, the compositions and methods of the present disclosure may comprise certain nucleic acid sequences that may function as guide sequences and enable the insertion of a nucleic acid sequence at a specific target site of a genome.

In some aspects of the present disclosure, compositions as described herein can comprise a promoter (e.g., a transcriptional promoter) that may regulate the expression of a gene in interest in a target cell, one or more target cell populations, or one or more target tissues. In some cases, the transcriptional promoter is activated in response to one or more factors (e.g., such as p16, p21, or p53) each of which is produced within the target cell. The gene of interest may be operably linked to and under regulatory control of the transcriptional promoter. In other aspects, the promoters as described herein may be tissue-specific and responsive to activation by transcription factors including SP1, ETS1, and/or ETS2. In some cases, the transcriptional promoter can include the $p21^{cip1/waf1}$ promoter, the $p27^{kip1}$ promoter, the $p57^{kip2}$ promoter, the TdT promoter, the Rag-1 promotor, the B29 promoter, the Blk promoter, the CDE19 promoter, the BLNK promoter, an HSP (e.g., HSP70) promotor, the TYR promoter, and/or the λ5 promoter. In some cases, a promoter can be globin promoter. In some cases, the promoter can be alpha-globin, a bet-globin, or a gamma-globin promoter.

In some aspects of the present disclosure, a nucleic acid may include natural or unnatural nucleotide analogues or bases or a combination thereof. The unnatural nucleotide analogues or bases may comprise modifications at one or more of ribose moiety, phosphate moiety, nucleoside moiety, or a combination thereof. The unnatural nucleotide analogues or bases may comprise 2'-O-methyl, 2'-O-methoxy-ethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, locked nucleic acid (LNA), ethylene nucleic acid (ENA), peptide nucleic acid (PNA), 1',5'-anhydrohexitol nucleic acids (HNA), morpholino, methylphosphonate nucleotides, thiolphosphonate nucleotides, or 2'-fluoro N3-P5'-phosphoramidites. A nucleic acid of the present disclosure may further comprise one or more abasic sites. The abasic site may further be functionalized with a detectable moiety.

As used herein, the term "transcriptional promoter" refers to a region of a nucleic acid sequence that initiates transcription of a particular gene. Promoters are generally located near transcription start sites of genes, on the same strand and upstream on the DNA (towards the 3' region of the anti-sense strand, also called template strand and non-coding strand). Promoters can be about 100-1000 base pairs long. Promoters contain specific DNA sequences and response elements that provide a secure initial binding site for RNA polymerase and for proteins called transcription factors that recruit RNA polymerase. These transcription factors have specific activator or repressor sequences of corresponding nucleotides that attach to specific promoters and regulate gene expressions. The process is more complicated, and at least seven different factors are necessary for the binding of an RNA polymerase II to the promoter. Promoters represent critical elements that can work in concert with other regulatory regions (enhancers, silencers, boundary elements/insulators) to direct the level of transcription of a given gene. Eukaryotic transcriptional promoters comprise a number of essential elements, which collectively constitute a core promoter (i.e., the minimal portion of a promoter that is required to initiate transcription). Those elements generally include (1) a transcription start site (TSS), (2) an RNA polymerase binding site (in particular an RNA polymerase II binding site in a promoter for a gene encoding a messenger RNA), (3) a general transcription factor binding site (e.g., a TATA box having a consensus sequence TATAAA, which is a binding site for a TATA-binding protein (TBP)), (4) a B recognition element (BRE), (5) a proximal promoter of approximately 250 bp that contains regulatory elements, (6) transcription factor binding sites (e.g., an E-box having the sequence CACGTF, which is a binding site for basic helix-loop-helix (bHLH) transcription factors including BMAL11-Clock and cMyc), and (7) a distal promoter containing additional regulatory elements. As used herein, the term "transcriptional promoter" is distinct from the term "enhancer," which refers to a regulatory element that is distant from the transcriptional start site. Eukaryotic promoters are often categorized according to the following classes: (1) AT-based class, (2) CG-based class, (3) ATCG-compact class, (4) ATCG-balanced class, (5) ATCG-middle class, (6) ATCG-less class, (7) AT-less class, (8) CG-spike class, (9) CG-less class, and (10) ATspike class. See, Gagniuc and Ionescu-Tirgoviste, BMC Genomics 13:512 (2012). Eukaryotic promoters can be "unidirectional" or "bidirectional." Unidirectional promoters regulate the transcription of a single gene and are characterized by the presence of a TATA box. Bidirectional promoters are short (<1 kilo base pairs (kbp)), intergenic regions of DNA between the 5' ends of genes in a bidirectional gene pair (i.e., two adjacent genes coded on opposite strands having 5' ends oriented toward one another. Bidirectional genes are often functionally related and because they share a single promoter, can be co-regulated and co-expressed. Unlike unidirectional promoters, bidirectional promoters do not contain a TATA box but do contain GpC islands and exhibit symmetry around a midpoint of dominant Cs and As on one side and Gs and Ts on the other. CCAAT boxes are common in bidirectional promoters as are NRF-1, GABPA, YY1, and ACTACAnnTCCC (SEQ ID NO: 278) motifs.

As used herein, the term "transcription factor" refers to sequence-specific DNA-binding factors that bind to specific sequences within a transcriptional promoter thereby regulating the transcription of a nucleic acid that is in operable proximity to and downstream of the promoter. Transcription factors include activators, which promote transcription, and repressors, which block transcription by preventing the recruitment or binding of an RNA polymerase.

As used herein, the term "suicide gene" refers to a class of genes that produce proteins that induce p53-mediated apoptotic cell killing. Suicide genes that can be employed in the expression constructs and systems of the present disclosure include the caspases, CASP3, CASP8, CASP9, BAX, DNA fragmentation factor (DFF) 40, Herpes Simplex Virus Thymidine Kinase (HSV-TK), and cytosine deaminase and inducible variants of CASP3, CASP8, CASP9, BAX, DFF40, Herpes HSV-TK, and cytosine deaminase.

The isolated nucleic acid can have transposon functionality, such as a class II transposon.

Detection of Cell Specific Cancer Zip Code Sequences by Screening Biological Samples In some instances, the present disclosure provides methods for screening for a cancer in a subject (e.g., a rodent or a human) by detecting cell- and tissue-type specific cell-free human cell targeting sequences (sometimes comprising one or more ZCSs) in a biological sample. In some instances the disclosure provides a method comprising: obtaining a biological sample of a subject; detecting whether a nucleic acid sequence that has at least 90% sequence identity to SEQ ID NO: 1-SEQ ID NO: 277, or SEQ ID NO: 282 is present in said biological sample by contacting a probe with said biological sample and detecting hybridization between the probe and the nucleic acid sequence; and characterizing a health state of said biological sample of said subject based on whether said nucleic acid is detected by said hybridization. In other instances, the disclosure provides a method comprising: obtaining a biological sample of a subject; quantifying a level of a nucleic acid sequence that has at least 90% sequence identity to SEQ ID NO: 1-SEQ ID NO: 277, or SEQ ID NO: 282 in said biological sample by one or more processes selected from: reverse transcription, polynucleotide amplification, or sequencing; comparing, in a computer system, said quantified level of said nucleic acid sequence to a reference; and characterizing a health state of said biological sample of said subject based on whether said nucleic acid is detected by said one or more processes.

In some cases, the isolated nucleic acid sequence can be at least 200 base pairs in length. In some cases, the isolated nucleic acid sequence can be at least 400 base pairs in length. In some instances, said nucleic acid sequence can range from about 200 base pairs to about 800 base pairs in length. In some instances, said nucleic acid sequence can range from about 400 base pairs to about 2,000 base pairs in length. In some instances, said nucleic acid sequence can range from about 400 base pairs to about 5,000 base pairs in length. In some instances, said nucleic acid sequence can range from about 1,500 base pairs to about 7,200 base pairs in length. In some instances, said nucleic acid sequence can range from about 1,900 base pairs to about 5,800 base pairs in length. In some instances, said nucleic acid sequence can range from about 2,000 base pairs to about 10,000 base pairs in length. In some instances, said nucleic acid sequence can range from about 5,000 base pairs to about 15,000 base pairs in length. In some instances, said nucleic acid sequence can range from about 600 base pairs to about 16,900 base pairs in length. In some instances, said nucleic acid sequence can range from about 8,000 base pairs to about 18,000 base pairs in length. In some instances, said nucleic acid sequence can range from about 10,000 base pairs to about 20,000 base pairs in length. In some instances, said nucleic acid sequence can range from about 400 base pairs to about 20,000 base pairs in length.

Treatment of a Disease or Condition In Vivo

In various aspects, the human cell-targeting nucleic acid sequences of the present disclosure may be used to target a specific cell, cell population, tissue, or organ in vivo (i.e., in a living organism or subject) following administration. In some cases, and due to their high specificity for a specific cell, cell population, tissue, or organ, the human cell-targeting nucleic acid sequences of the present disclosure may be used in combination with cargos to deliver those cargos to a specific location within an organism or subject. In some cases, the delivery of such cargos may be used for therapeutic and/or diagnostic purposes to, for example, treat and/or detect a disease or condition or an onset of a disease or condition with high specificity in vivo. In some cases, the human cell-targeting nucleic acid sequences of the present disclosure may enable a highly targeted treatment. In some cases, the human cell-targeting nucleic acid sequences of the present disclosure may enable the detection of a disease or condition or the onset of a disease or condition including drivers of the disease or condition in a highly specific manner. In some cases, the diagnosis of a disease or condition may be non-invasive and thus a specific disease or condition may be detected in a living organism or subject with the use of invasive methods (e.g., surgery).

As described in further detail herein, for example, the cargo may include nucleic acid molecules that code for therapeutic proteins, or protein, peptide and small molecule drugs, or a variety of detectable moieties such as fluorescent labels or radioactive labels that allow for in vivo tracking of the human cell-targeting nucleic acid sequences as disclosed herein.

Due to their modular nature (see, e.g., FIG. 12 or FIG. 20), the human cell-targeting nucleic acid sequences and systems of the present disclosure may be used to prevent, treat, and/or diagnose a variety of diseases and conditions which may include chronic, metabolic, and infectious diseases or conditions such as cancer, or diabetes.

In various aspects, the human cell-targeting nucleic acid sequences of the present disclosure may be formulated as pharmaceutical compositions and administered to an organism of subject using a variety of administration routes, including systemic and local administration. Upon administration, the human cell-targeting nucleic acid sequences distribute within the live organism of subject and may be detected during circulation and organ uptake via the detection of signals released by detectable moieties such as fluorescent dyes or radioactive isotopes. Upon uptake of the cell-targeting nucleic acid sequences by the cell, cell population, tissue, or organ in vivo, the cell-targeting nucleic acid sequences may deliver a cargo as described herein to the target site or multiple target sites. Due to their high specificity for a specific cell, cell population, tissue, or organ, the nuclei acid constructs of the present disclosure predominantly accumulate at the target sites and as such may be highly specific delivery vehicles for a variety of cargos.

Use of Zip Code Sequences in the Treatment of Cancer

Many cancers, particularly solid tumors of several types, are difficult to treat as it is difficult to achieve a high enough level of effective drug into such tumors while managing negative side effects of the drugs in normal tissues. Consequently, there is a need for targeting drugs to, for example, solid tumors specifically to achieve a higher effective dose of drug in tumor while minimizing the level of negative side effects in other tissues. Moreover, there is also a need for targeting drugs specifically to rapidly growing cancerous cell. Typical cancer drug regimens are often limited by dose-limiting toxicities, and although some antibody-drug conjugates are used to target drugs to specific tumors in order to limit off-site toxicity, such specific therapies are not available for many solid tumors. Provided herein are nucleic acid constructs and delivery systems that can specifically deliver a cargo, such as drug, to a cell. In certain instances, the nucleic acid construct comprising the zip code itself possesses or induces therapeutic responses.

The present disclosure describes a class of cell-targeting nucleic acid sequences that can comprise one or more cell/tissue-specific ZCSs derived from cell-free tumor DNA specific samples that can home to, target, be directed to, accumulate in, penetrate the cytoplasm and nucleus of a cancerous or diseased cells. Such cell-targeting nucleic acids of the disclosure can specifically target one or more human cell types. Thus, they can be used either directly or as carriers of active drugs, nucleic acid constructs or molecules to treat the cancerous or diseased cells. A nucleic acid sequence that can specifically home to, target, be directed to, accumulate in, penetrate the cytoplasm and nucleus in one or more specific cancerous or diseased regions, tissues, structures or cells can have fewer off-target and potentially negative effects.

The present disclosure also provides a new kind of carrier that can deliver an active agent or detectable agent to a specific region, tissue, structure or cell that can be used for either or both therapeutic and imaging purposes. As described herein, an active agent or detectable agent can be linked to a nucleic acid sequence comprising one or more Zip Code Sequences of the disclosure.

The disclosure also provides a method for treating a condition of a subject, wherein the method comprises administrating to the subject a ZCS that homes, targets, migrates to, is directed to a region, tissue, or cell of the subject, for example within the cytoplasm or nucleus of a specific target cell, for example, a multiple myeloma, a pancreatic cancer, or a lung cancer cell. In some cases, the administered nucleic acid construct can cross the nucleus of a target cell of the subject and become integrated into the subject's cell.

In one embodiment, the method includes administering an effective amount of a ZCS nucleic acid construct, which can optionally comprise a therapeutic cargo, to a subject in need thereof.

The term "effective amount," as used herein, refers to a sufficient amount of an agent or a compound being administered which will relieve to some extent one or more of the symptoms of the disease or condition being treated. The result can be reduction and/or alleviation of the signs, symptoms, or causes of a disease, or any other desired alteration of a biological system. Compositions containing such agents or compounds can be administered for prophylactic, enhancing, and/or therapeutic treatments. An appropriate "effective" amount in any individual case may be determined using techniques, such as a dose escalation study. In some cases, a therapeutically effective amount (e.g., to prevent and/or treat a disease or disorder) of a nucleic acid Zip Code sequence may be from about 1 picogram (μg) to about 1 g. A therapeutically effective amount of a ZCS may be from about 1 nanogram (ng) to about 100 mg. A therapeutically effective amount of a ZCS may be from about 100 ng to about 10 mg. A therapeutically effective amount of a ZCS may be from about 1 microgram μg to about 10 mg. A therapeutically effective amount of a ZCS may be from about 100 μg to about 1 mg.

A ZCS or a construct comprising one or more ZCSs may be administered in combination with one or more other ZCSs or constructs comprising one or more ZCSs. A ZCS or a construct comprising one or more ZCSs may be administered in combination with one or more other therapeutic molecules (e.g., small molecule drugs, immunotherapeutic agents (e.g., immune check point blocker), therapeutic antibodies, etc.).

The methods, compositions, and kits of this disclosure may comprise a method to prevent, treat, arrest, reverse, or ameliorate the symptoms of a condition. The treatment may comprise treating a subject (e.g., an individual, a domestic animal, a wild animal, or a lab animal afflicted with a disease or condition) with a nucleic acid construct or ZCS comprising system(s) of the disclosure. The disease may be a cancer or tumor. In treating the disease, the nucleic acid molecules of the present disclosure may contact the tumor or cancerous cells. The subject may be a human. Subjects can be humans; non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. A subject can be of any age. Subjects can be, for example, elderly adults, adults, adolescents, pre-adolescents, children, toddlers, infants, and fetuses in utero.

Treatment may be provided to the subject before clinical onset of disease. Treatment may be provided to the subject after clinical onset of disease. Treatment may be provided to the subject after 1 day, 1 week, 6 months, 12 months, or 2 years or more after clinical onset of the disease. Treatment may be provided to the subject for more than 1 day, 1 week, 1 month, 6 months, 12 months, 2 years or more after clinical onset of disease. Treatment may be provided to the subject for less than 1 day, 1 week, 1 month, 6 months, 12 months, or 2 years after clinical onset of the disease. Treatment may also include treating a human in a clinical trial. Treatment using the herein described ZCSs may comprise administering a ZCS or a construct comprising one or more ZCSs one or more times daily. In some cases, such daily administrations comprise the same or different amounts of the ZCS or a construct comprising one or more ZCSs, and/or comprise one or more other therapeutic molecules as described herein.

A treatment can comprise administering to a subject a pharmaceutical composition, such as one or more of the pharmaceutical compositions described throughout the disclosure. A treatment can comprise delivering a nucleic acid molecule or nucleic acid delivery system of the disclosure to a subject, either intravenously, subcutaneously, intramuscularly, by inhalation, dermally, topically, orally, sublingually, intrathecally, transdermally, intranasally, via a peritoneal route, or directly into the brain, e.g., via and intracerebral ventrical route. A treatment can comprise administering a nucleic acid molecule- or nucleic acid delivery system-active agent complex to a subject, either intravenously, subcutaneously, intramuscularly, by inhalation, dermally, topically, orally, intrathecally, transdermally, intransally, parenterally, orally, via a peritoneal route, nasally, sublingually, or directly into the brain.

In some embodiments, the present disclosure provides a method for treating a cancer or tumor, the method comprising administering to a subject in need thereof an effective amount of a nucleic acid delivery system of the present disclosure. One example of cancers or conditions that can be treated with a nucleic acid molecule (or nucleic acid molecule-cargo conjugate) of the disclosure is solid or liquid tumors. Further examples of cancers or conditions that can be treated with a nucleic acid construct or ZCS comprising system(s) of the disclosure include triple negative breast cancer, breast cancer, breast cancer metastases, ER/PR-positive breast cancer, metastases of any cancers described herein, colon cancer, colon cancer metastases, sarcomas, acute lymphoblastic leukemia, acute myeloid leukemia, adrenocortical carcinoma, AIDS-related cancers such as Kaposi sarcoma, AIDS-related lymphoma, primary CNS lymphoma, anal cancer, appendix cancer, childhood astrocytomas, astrocytomas, childhood atypical teratoid/rhabdiod tumor, CNS atypical teratoid/rhabdiod tumor, atypical teratoid/rhabdiod tumor, basal cell carcinoma, skin cancer, bile duct cancer, bladder cancer, bone cancer, Ewing sarcoma family of tumors, osteosarcoma, chondroma, chondrosarcoma, primary and metastatic bone cancer, malignant fibrous histiocytoma, childhood brain stem glioma, brain stem glioma, brain tumor, brain and spinal cord tumors, central nervous system embryonal tumors, childhood central nervous system embryonal tumors, central nervous system germ cell tumors, childhood central nervous system germ cell tumors, craniopharyngioma, childhood craniopharyngioma, ependymoma, childhood ependymoma, breast cancer, bronchial tumors, childhood bronchial tumors, burkitt lymphoma, carcinoid tumor, gastric cancer, carcinoma of unknown primary, cardiac tumors, childhood cardiac tumors, primary lymphoma, cervical cancer, cholangiocarcinoma, chordoma, childhood chordoma, chronic lymphocytic leukemia, chronic myelogenous leukemia, chronic myeloproliferative neoplasms, colon cancer, colorectal cancer, cutaneous T cell lymphoma, ductal carcinoma in situ, endometrial cancer, esophageal cancer, esthesioneuroblastoma, childhood esthesioneuroblastoma, ewing sarcoma, extracranial germ cell tumor, childhood extracranial germ cell tumor, extragonadal germ cell tumor, eye cancer, intraocular melanoma, retinoblastoma, fallopian tube cancer, fibrous histiocytoma of bone, gallbladder cancer, gastric cancer, gastrointestinal carcinoid tumor, gastrointestinal stromal tumors, ovarian cancer, testicular cancer, gestational trophoblastic disease, glioma, hairy cell leukemia, head and neck cancer, hepatocellular cancer, histiocytosis, Langerhans cell histiocytosis, hodgkin lymphoma, hypopharyngeal cancer, intraocular melanoma, melanoma, melanoma metastases, islet cell tumors, pancreatic neuroendocrine tumors, kidney cancer, renal cell tumors, Wilms tumor, childhood kidney tumors, lip and oral cavity cancer, liver cancer, lung cancer, nonhodgkin lymphoma, macroglodulinemia, Waldenstrom macroglodulinemia, male breast cancer, merkel cell carcinoma, metastatic squamous neck cancer with occult primary, midline tract carcinoma involving NUT gene, mouth cancer, multiple endocrine neoplasia syndromes, childhood multiple endocrine neoplasia syndromes, multiple myeloma/plasma cell neoplasm, mycosis fungoides, myelodysplastic syndromes, myelodysplastic/myeloproliferative neoplasms, multiple myeloma, myloproliferative neoplasms, chronic myeloproliferative neoplasms, nasal cavity and paranasal sinus cancer, nasopharyngeal cancer, neuorblastoma, non-small cell lung cancer, oropharyngeal cancer, low malignant potential tumor, pancreatic cancer, pancreatic neuroendocrine tumors, papillomatosis, childhood papillomatosis, paraganglioma, paranasal sinus and nasal cavity cancer, parathyroid cancer, penile cancer, pheochromocytoma, pharyngeal cancer, pituitary tumor, pleuropulmonary blastoma, childhood pleuropulmonary blastoma, primary peritoneal cancer, prostate cancer, rectal cancer, pregnancy-related cancer, rhabdomyosarcoma, childhood rhabdomyosarcoma, salivary gland cancer, Sezary syndrome, small cell lung cancer, small intestine caner, soft tissue sarcoma, squamous cell carcinoma, testicular cancer, throat cancer, thymoma, thymic carcinoma, thyroid cancer, transitional cell cancer of the renal, pelvis, and ureter, uterine cancer, urethral cancer, endometrial cancer, uterine sarcoma, vaginal cancer, vascular tumors, and vulvar cancers.

Exemplary carcinoma cell samples may include, but are not limited to, cell samples obtained from an anal cancer, appendix cancer, bile duct cancer (i.e., cholangiocarcinoma), bladder cancer, brain tumor, lung cancer, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer.

The cancerous cell sample may comprise cells obtained from a hematologic malignancy. Hematologic malignancy may comprise a leukemia, a lymphoma, a myeloma, a non-Hodgkin's lymphoma, or a Hodgkin's lymphoma. The hematologic malignancy may be a T cell based hematologic malignancy. The hematologic malignancy may be a B-cell based hematologic malignancy. Exemplary B-cell based hematologic malignancy may include, but are not limited to, chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenström's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis. Exemplary T cell based hematologic malignancy may include, but are not limited to, peripheral T cell lymphoma not otherwise specified (PTCL-NOS), anaplastic large cell lymphoma, angioimmunoblastic lymphoma, cutaneous T cell lymphoma, adult T cell leukemia/lymphoma (ATLL), blastic NK-cell lymphoma, enteropathy-type T cell lymphoma, hematosplenic gamma-delta T cell lymphoma, lymphoblastic lymphoma, nasal NK/T cell lymphomas, treatment-related T cell lymphomas, or hairy cell leukemia.

Zip Code Sequence-Mediated Gene Delivery can Alter the Phenotype of a Target Cell The methods and compositions of the present disclosure may be useful for altering the phenotype of a target cell and/or a target cell population. In some cases, phenotypic alteration of target cells in a subject may improve the therapeutic and/or clinical response of the subject to a therapeutic intervention.

The human cell-targeting sequences (Zip Codes) as described herein can be linked to one or more genes of interest and thus may be used for the cell- and/or tissue-specific delivery of those genes without the need for viral vector systems. In some cases, the gene of interest may encode a specific protein or polypeptide such as a surface receptor that—once expressed in the target cell—can make the cell responsive to extracellular stimuli to which the cell was previously unresponsive, or against which the cell developed resistance mechanisms. Thus, the methods and compositions of the present disclosure can be used to reverse a resistance mechanism in a cell or to induce responsiveness of a cell to certain extracellular or exogenous stimuli. For example, the gene of interest may encode a surface receptor such as an estrogen receptor (ER), a human epidermal growth factor receptor 2 (HER2) and/or 3 (HER3), or other surface markers (or biomarkers) including cluster of differentiation (CD) surface proteins (e.g., CD19, CD22, CD138, CD34, PD1, CD38, or SLAM7). The expression of such artificially introduced genes may change the phenotype a cell from, for example, HER-negative to HER2-positive. In some instance, for example, a HER2-positive primary tumor may develop HER2-negative distant lesions that show no or only very limited response to anti-HER2 therapy including the administration of anti-HER2 antibodies such as trastuzumab. Thus, the methods and compositions of the present disclosure can be used to convert HER2-negative tumors into HER2-positive tumor and thus increase their susceptibility to anti-HER2 treatment. As another example, tumor cells may downregulate certain pathways (e.g., nucleotide synthesis or DNA repair) in response to targeted therapy or chemotherapy, such as gemcitabine, and thus evade these treatment approaches resulting in low response rates and overall survival. Hence, the methods and compositions of the present disclosure can be used to reverse those resistance mechanisms and to overexpress certain proteins which, in combination with therapeutic drug molecules, may significantly increase a tumor's susceptibility to a treatment.

In further aspects of the present disclosure, the compositions as described herein can be used to increase expression of immunomodulatory proteins in a target cell. For example, nucleic acid constructs and systems of the disclosure can be used to increase the production of immune check points such as programmed cell death receptor-1 (PD-1) and/or programmed cell death receptor ligand 1 (PD-L1). Moreover, the nucleic acid sequences of the present disclosure can comprise genes encoding for proteins including, but not limited to, CTLA-4, BTLA, TIM-3, CCR5, CXCR4, TCR, B2M, a chimeric antigen receptor (CAR), genes responsible for bioprotein production, albumin in the liver, the hemoglobin subunit beta gene, the hemoglobin subunit alpha 1 gene, transthyretin (TTR), CCR5, glucocorticoid (GR), T cell receptor (TCR), CD52, BCL11A, alpha-L iduronidase (IDUA), iduronate-2-sulfatase (IDS), Factor 9, PD-1/TCR-A/TCR-B, TCR/CS-1, TCR, CEP290, TCR/B2M, CBLB, TGFbR, dystrophin, CFTR, serpinal, IL2Rg, or HBV.

Zip Code Sequence-Mediated and Cell-Specific Production of Neoantigens

The human cell-targeting sequences of the present disclosure may be used to produce neoantigens in a target cell, a target cell population, and/or a target tissue that can then be targeted with specifically designed drug molecules (e.g., therapeutic antibodies or antibody-drug conjugates) that exhibit affinity for those neoantigens. In other words, the ZCSs of the present disclosure can be used to increase or to artificially induce sensitivity of a target cell to a drug and thus offer new and effective treatment options. As described herein, neoantigens are generally understood as antigens encoded by tumor-specific mutated genes.

In some aspects of the present disclosure, the methods and compositions can be useful to increase the efficacy of immunotherapeutic approaches. For example, current immunotherapies targeting only show promising outcomes in a small fraction of patients (approximately 15-25%). One example to use the herein described compositions in order to enhance the ability of a subject's own immune system to more effectively recognize and attack tumor cells may be by producing neoantigens in cancer cells that enable the immune system to recognize the tumor cells as foreign. For example, the compositions as described herein may also be used to induce expression of bacterial or viral in tumor cells for which a subjects may have innate or acquired immunity (e.g., had been vaccinated against that specific antigen in the past) and thus may allow memory B cells to recognize and destroy cancer cells expressing the respective bacterial or viral antigens.

The herein disclosed methods and compositions may be used in combination with existing drugs such as immune checkpoint inhibitors targeting the PD-1/PD-L1 axis, or other immune checkpoints such as cytotoxic T lymphocyte-associated molecule 4 (CTLA-4) or LAG-3, TIM-3, TIGIT, VISTA, or B7/H3. It has been shown that currently available immunotherapies are more effective in tumors with high mutational burden (e.g., lung cancer caused by smoking) and an increased presence of surface neoantigens that can be detected as foreign by T cells of the immune system. Thus, using the composition of the present disclosure to artificially increase the amount of non-native polypeptide fragments (i.e., neoantigens) that can be recognized by immune cells may increase the efficacy of immunotherapies for the prevention and treatment of cancer and other diseases.

In other instances, the present disclosure provides nucleic acid constructs and delivery systems that can be used to deliver viral, bacterial, fungal, or other foreign antigens to target cells of a subject (e.g., a rodent or a human) in order to elicit an immune response against such target cell in the subject. In some cases, such target cells can be cancer cells. Such foreign antigens can be delivered to such target cells by, e.g., using a delivery system of this disclosure comprising a cell-targeting sequence, an integration sequence, and a cargo nucleic acid sequence encoding such foreign antigen. The cargo nucleic acid sequence can be expressed by the target cell upon integration of such sequence into a genome of the target cell.

Zip Code Sequence-Mediated Production of Chimeric Antigen Receptor (CAR) T Cells In some aspects, the human cell-targeting sequences of the present disclosure can comprise Zip Code sequences and may be used to express an endogenous or an artificial receptor in a target cell. In some cases, the artificial receptor can be a chimeric antigen receptor (CAR) that may be expressed in a particular target cell population (e.g., T lymphocytes). The high specificity for a particular target cell or cell population and the ability to self-integrate may enable the Zip Code sequences to be used as targeting sequences for efficient and reproducible integration of the CAR gene. Currently available approaches for producing CARs in T cells (i.e., CAR T cells) using a variety of viral vector systems (e.g., adeno-viral or lentiviral vectors) generally have limited clinical utility due to high heterogeneity of ex vivo CAR gene integration within a T cell population, resulting in low reproducibility when comparing multiple batch production. Thus, the compositions and methods as described herein can be used to increase the efficacy and homogeneity of CAR gene transfection within a clinically relevant cell population (e.g., T cells).

Zip Code Sequences Prevent Tumor Growth and Relapse of Disease

The herein described nucleic acid Zip Code Sequences (ZCSs) can also be used to prevent tumor growth and relapse of disease. In some cases, the ZCSs of this disclosure can be used to bind and/or capture circulating tumor nucleic acid molecules when administered to a subject having or suspected of having cancer.

The composition and methods of this disclosure allow for the isolation and/or synthesis of cancer type-specific ZCSs. The specificity of these ZCSs to circulating tumor nucleic acid molecules derived from the same tumor type may result in the formation of hybridization complexes when a ZCS of this disclosure is contacted with a circulating tumor nucleic acid molecule in the subject. This may prevent the circulating tumor nucleic acid molecule (e.g., ctDNA) to reach its destination tissue or organ and thus may prevent or reduce the incidence of metastases formation, cellular cross-talk between tumor cells and other mechanisms associated with tumor growth and development.

In some cases, tumor-specific consensus sequences or consensus ZCSs as described herein can be used to prevent cancer in a subject and/or to prevent relapse of a cancerous disease. The versatility of the herein described methods may allow the production and/or synthesis of ZCSs that can be used for virtually any tumor type.

In some cases, the ZCSs of the present disclosure can be conjugated, bound to, or linked to one or more molecules that may allow for improved binding or capturing of circulating tumor nucleic acid molecules. Such molecules can include those that enhance the binding affinity of the ZCS for a circulating tumor nucleic acid molecule associated with a specific tumor type. These molecules can further include those chemical moieties that alter the biodistribution, pharmacokinetics and/or pharmacodynamics of the ZCSs. In some cases, a ZCS can be modified such that the removal of the circulating tumor nucleic acid molecule from the circulation is enhanced or accelerated, e.g., via excretion, metabolic (e.g., enzymatic) transformation or inactivation.

The ZCSs can be used to determine the biodistribution of circulating tumor nucleic acid molecule in a subject, as well as the amount of circulating tumor nucleic acid molecule in the blood of said subject (e.g., by measuring the amount of bound or hybridized ZCS, which may be labeled with a dye).

Use of Nucleic Acid ZCSs for Cargo Delivery

Nucleic acid sequences and systems as disclosed herein can be conjugated to an agent used in imaging, research, therapeutics, theranostics, pharmaceuticals, chemotherapy drugs, chelation therapy, targeted drug delivery, and radiotherapy.

In some embodiments, a cell- or tissue-type specific ZCSs is conjugated to or fused with detectable agents, such as a fluorophore, a near-infrared dye, a contrast agent, a nanoparticle, a metal-containing nanoparticle, a metal chelate, an X-ray contrast agent, a PET agent, a metal, a radioisotope, a dye, radionuclide chelator, or another suitable material that can be used in imaging. In some cases, 1, 2, 3, 4, 5, 6, 7, 8, 9, or 10 detectable agents can be linked to a cell- or tissue-type specific ZCSs. Non-limiting examples of radioisotopes include alpha emitters, beta emitters, positron emitters, and gamma emitters. In some cases, the metal or radioisotope is selected from the group consisting of actinium, americium, bismuth, cadmium, cesium, cobalt, europium, gadolinium, iridium, lead, lutetium, manganese, palladium, polonium, radium, ruthenium, samarium, strontium, technetium, thallium, and yttrium. In some cases, the metal is actinium, bismuth, lead, radium, strontium, samarium, or yttrium.

In some cases, the fluorophore is a fluorescent agent emitting electromagnetic radiation at a wavelength between 650 nm and 4000 nm, such emissions being used to detect such agent. Non-limiting examples of fluorescent dyes that could be used as a conjugating molecule in the present disclosure include DyLight-680, DyLight-750, VivoTag-750, DyLight-800, IRDye-800, VivoTag-680, Cy5.5, or indocyanine green (ICG). In some cases, near infrared dyes often include cyanine dyes (e.g., Cy7, Cy5.5, and Cy5). Additional non-limiting examples of fluorescent dyes for use as a conjugating molecule in the present disclosure include acradine orange or yellow, Alexa Fluors (e.g., Alexa Fluor 790, 750, 700, 680, 660, and 647) and any derivative thereof, 7-actinomycin D, 8-anilinonaphthalene-1-sulfonic acid, ATTO dye and any derivative thereof, auramine-rhodamine stain and any derivative thereof, bensantrhone, bimane, 9-10-bis(phenylethynyl)anthracene, 5,12-bis(phenylethynyl)naththacene, bisbenzimide, brainbow, calcein, carbodyfluorescein and any derivative thereof, 1-chloro-9,10-bis(phenylethynyl)anthracene and any derivative thereof, DAPI, DiOC6, DyLight Fluors and any derivative thereof, epicocconone, ethidium bromide, FlAsH-EDT2, Fluo dye and any derivative thereof, FluoProbe and any derivative thereof, Fluorescein and any derivative thereof, Fura and any derivative thereof, GelGreen and any derivative thereof, GelRed and any derivative thereof, fluorescent proteins and any derivative thereof, m isoform proteins and any derivative thereof such as for example mCherry, hetamethine dye and any derivative thereof, hoeschst stain, iminocoumarin, indian yellow, indo-1 and any derivative thereof, laurdan, lucifer yellow and any derivative thereof, luciferin and any derivative thereof, luciferase and any derivative thereof, mercocyanine and any derivative thereof, nile dyes and any derivative thereof, perylene, phloxine, phyco dye and any derivative thereof, propium iodide, pyranine, rhodamine and any derivative thereof, ribogreen, RoGFP, rubrene, stilbene and any derivative thereof, sulforhodamine and any derivative thereof, SYBR and any derivative thereof, synaptopHluorin, tetraphenyl butadiene, tetrasodium tris, Texas Red, Titan Yellow, TSQ, umbelliferone, violanthrone, yellow fluroescent protein and YOYO-1. Other Suitable fluorescent dyes include, but are not limited to, fluorescein and fluorescein dyes (e.g., fluorescein isothiocyanine or FITC, naphthofluorescein, 4',5'-dichloro-2',7'-dimethoxyfluorescein, 6-carboxyfluorescein or FAM, etc.), carbocyanine, merocyanine, styryl dyes, oxonol dyes, phycoerythrin, erythrosin, eosin, rhodamine dyes (e.g., carboxytetramethylrhodamine or TAMRA, carboxyrhodamine 6G, carboxy-X-rhodamine (ROX), lissamine rhodamine B, rhodamine 6G, rhodamine Green, rhodamine Red, tetramethylrhodamine (TMR), etc.), coumarin and coumarin dyes (e.g., methoxycoumarin, dialkylaminocoumarin, hydroxycoumarin, aminomethylcoumarin (AMCA), etc.), Oregon Green Dyes (e.g., Oregon Green 488, Oregon Green 500, Oregon Green 514, etc.), Texas Red, Texas Red-X, SPECTRUM RED, SPECTRUM GREEN, cyanine dyes (e.g., CY-3, Cy-5, CY-3.5, CY-5.5, etc.), ALEXA FLUOR dyes (e.g., ALEXA FLUOR 350, ALEXA FLUOR 488, ALEXA FLUOR 532, ALEXA FLUOR 546, ALEXA FLUOR 568, ALEXA FLUOR 594, ALEXA FLUOR 633, ALEXA FLUOR 660, ALEXA FLUOR 680, etc.), BODIPY dyes (e.g., BODIPY FL, BODIPY R6G, BODIPY TMR, BODIPY TR, BODIPY 530/550, BODIPY 558/568, BODIPY 564/570, BODIPY 576/589, BODIPY 581/591, BODIPY 630/650, BODIPY 650/665, etc.), IRDyes (e.g., IRD40, IRD 700, IRD 800, etc.), and the like. Additional suitable detectable agents are described in PCT/US14/56177. Non-limiting examples of radioisotopes include alpha emitters, beta emitters, positron emitters, and gamma emitters. In some embodiments, the metal or radioisotope is selected from the group consisting of actinium, americium, bismuth, cadmium, cesium, cobalt, europium, gadolinium, iridium, lead, lutetium, manganese, palladium, polonium, radium, ruthenium, samarium, strontium, technetium, thallium, and yttrium. In some embodiments, the metal is actinium, bismuth, lead, radium, strontium, samarium, or yttrium. In some embodiments, the radioisotope is actinium-225 or lead-212.

The present disclosure provides cell- or tissue-type specific human cell-targeting nucleic acid sequences conjugated to a radiosensitizer or photosensitizer. Examples of radiosensitizers include but are not limited to: ABT-263, ABT-199, WEHI-539, paclitaxel, carboplatin, cisplatin, oxaliplatin, gemcitabine, etanidazole, misonidazole, tirapazamine, and nucleic acid base derivatives (e.g., halogenated purines or pyrimidines, such as 5-fluorodeoxyuridine). Examples of photosensitizers include but are not limited to: fluorescent molecules or beads that generate heat when illuminated, nanoparticles, porphyrins and porphyrin derivatives (e.g., chlorins, bacteriochlorins, isobacteriochlorins, phthalocyanines, and naphthalocyanines), metalloporphyrins, metallophthalocyanines, angelicins, chalcogenapyrrillium dyes, chlorophylls, coumarins, flavins and related compounds such as alloxazine and riboflavin, fullerenes, pheophorbides, pyropheophorbides, cyanines (e.g., merocyanine 540), pheophytins, sapphyrins, texaphyrins, purpurins, porphycenes, phenothiaziniums, methylene blue derivatives, naphthalimides, nile blue derivatives, quinones, perylenequinones (e.g., hypericins, hypocrellins, and cercosporins), psoralens, quinones, retinoids, rhodamines, thiophenes, verdins, xanthene dyes (e.g., eosins, erythrosins, rose bengals), dimeric and oligomeric forms of porphyrins, and prodrugs such as 5-aminolevulinic acid. Advantageously, this approach allows for highly specific targeting of diseased cells (e.g., cancer cells) using both a therapeutic agent (e.g., drug) and electromagnetic energy (e.g., radiation or light) concurrently.

In some aspects, the compositions and methods of the present disclosure may be used to induce DNA damage and/or genomic instability in a target cell. For example, the use of radioactively labeled nucleic acid constructs can be used to cause radiation-induced DNA damage within a cell that is associated with a disease or condition. In some cases, the administration of a specific therapeutic amount of a nucleic acid constructs may cause a measurable reduction in proliferating cells, for example in a tumor tissue.

Pharmaceutical Compositions Comprising Cell- and Tissue-Type Specific Zip Code Sequences The present disclosure provides pharmaceutical compositions comprising one or more ZCSs as described herein. A pharmaceutical composition of the disclosure can be a combination of any nucleic acid construct comprising one or more of the cell-targeting and/or genomic integration nucleic acid sequence (e.g., ZCS) described herein with other chemical and/or pharmaceutically acceptable components, such as carriers, stabilizers, diluents, dispersing agents, suspending agents, thickening agents, antioxidants, solubilizers, buffers, osmolytes, salts, surfactants, amino acids, encapsulating agents, bulking agents, cryoprotectants, and/or excipients. The composition can facilitate administration of any nucleic acid construct or ZCS described herein to an organism. Compositions can be administered in therapeutically-effective amounts as pharmaceutical compositions by various forms and routes including, for example, intravenous, subcutaneous, intramuscular, rectal, aerosol, parenteral, ophthalmic, pulmonary, transdermal, vaginal, optic, nasal, oral, sublingual, inhalation, dermal, intrathecal, intranasal, and topical administration (e.g., for use in melanoma). A pharmaceutical composition can be administered in a local or systemic manner, for example, via injection of the nucleic acid molecules as described herein directly into an organ, optionally in a depot.

Parenteral injections can be formulated for bolus injection or continuous infusion. The pharmaceutical compositions as described herein can be in a form suitable for parenteral injection as a sterile suspension, solution or emulsion in oily or aqueous vehicles, and can contain formulatory agents such as suspending, stabilizing and/or dispersing agents. Pharmaceutical formulations for parenteral administration include aqueous solutions of a human cell-targeting nucleic acid sequences as described herein in water soluble form. Suspensions of human cell-targeting nucleic acid sequences as described herein can be prepared as oily injection suspensions. Suitable lipophilic solvents or vehicles include fatty oils such as sesame oil, or synthetic fatty acid esters, such as ethyl oleate or triglycerides, or liposomes. Aqueous injection suspensions can contain substances which increase the viscosity of the suspension, such as sodium carboxymethyl cellulose, sorbitol, or dextran. The suspension can also contain suitable stabilizers or agents that increase the solubility and/or reduce the aggregation of such nucleic acid molecules described herein to allow for the preparation of highly concentrated solutions. Alternatively, the nucleic acid molecules and nucleic acid-cargo constructs as described herein can be lyophilized or in powder form for re-constitution with a suitable vehicle, e.g., sterile pyrogen-free water, before use. In some cases, a nucleic acid construct or ZCS is injected directly into a tissue. A nucleic acid construct or ZCS described herein can be administered to a subject, home, target, migrate to, penetrate an organ, e.g., the pancreas, or a cell, e.g. multiple myeloma cell.

A nucleic acid molecule and nucleic acid-cargo construct of the disclosure can be applied directly to an organ, or an organ tissue or cells, such as the lung or pancreas, during a surgical procedure. The nucleic acid construct or ZCS-comprising human cell-targeting nucleic acid sequence described herein can be administered topically and can be formulated into a variety of topically administrable compositions, such as solutions, suspensions, lotions, gels, pastes, medicated sticks, balms, creams, and ointments. Such pharmaceutical compositions can contain solubilizers, stabilizers, tonicity enhancing agents, buffers and preservatives.

In practicing the methods of treatment or use provided herein, therapeutically-effective amounts of the nucleic acid construct or ZCS described herein can be administered in pharmaceutical compositions to a subject suffering from a cancer. In some embodiments, the subject is a mammal such as a human. A therapeutically-effective amount can vary widely depending on the severity of the disease, the age and relative health of the subject, the potency of the compounds used, and other factors.

Pharmaceutical compositions can be formulated using one or more physiologically-acceptable carriers comprising excipients and auxiliaries, which facilitate processing of the active compounds into preparations that can be used pharmaceutically. Formulation can be modified depending upon the route of administration chosen. Pharmaceutical compositions comprising a nucleic acid molecule or nucleic acid delivery system described herein can be manufactured, for example, by expressing the peptide in a recombinant system, purifying the peptide, lyophilizing the nucleic acid molecule, mixing, dissolving, granulating, dragee-making, levigating, emulsifying, encapsulating, entrapping, or compression processes. The pharmaceutical compositions can include at least one pharmaceutically acceptable carrier, diluent, or excipient and compounds described herein as free-base or pharmaceutically-acceptable salt form.

Methods for the preparation of nucleic acids and nucleic acid systems (e.g., a ZCS attached to a cargo moiety) as described herein comprising the compounds described herein include formulating the nucleic acid construct or ZCS described herein with one or more inert, pharmaceutically-acceptable excipients or carriers to form a solid, semi-solid, or liquid composition. Solid compositions include, for example, powders, tablets, dispersible granules, capsules, cachets, and suppositories. These compositions can also contain minor amounts of nontoxic, auxiliary substances, such as wetting or emulsifying agents, pH buffering agents, and other pharmaceutically-acceptable additives.

Non-limiting examples of pharmaceutically-acceptable excipients can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pa. 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins1999), each of which is incorporated by reference in its entirety.

In-Vivo Uptake of Nucleic Acid Sequences

The uptake of the nucleic acid molecules and nucleic acid conjugates (e.g., a ZCS attached to a cargo moiety) of the present disclosure into a specific cell, cell population, tissue, or organ may be determined ex vivo (e.g., via tissue staining, fluorescence, PCR, etc.) or in vivo (e.g., tissue samples (e.g., blood samples, biopsies), non-invasive imaging, etc.). In the same way, the efficacy of cargo delivery may be determined ex vivo or in vivo. Ex vivo analyses include organ harvest and fixation (e.g., using 4% formaldehyde) of harvested tissue prior to analyses. Tissue samples may be analyzed using a variety of analytical methods including microscopy, spectroscopy, flow cytometry, polymerase chain reaction (PCR), and via measurements of ultrasound, electromagnetic radiation (e.g., UV/VIS, X-ray) or radioactivity. For example, tissue uptake may be determined by measuring luminescence or bioluminescence of a cell, cell population, tissue, or organ sample, or by measuring radioactivity of a cell, cell population, tissue, or organ sample and by calculating uptake values such as percent injected dose per gram (or per mole or per volume).

EMBODIMENTS

Embodiment 1. In some embodiments, the disclosure provides a pharmaceutical composition comprising a therapeutically effective amount of an isolated nucleic acid sequence derived from a circulating tumor DNA released by a cancerous cell wherein said isolated nucleic acid sequence targets a cell that is of the same cell type as said cancerous cell, which composition is formulated for administration to a subject.

Embodiment 2. The pharmaceutical composition of embodiment 1, wherein said cell is a human cell.

Embodiment 3. The pharmaceutical composition of embodiment 1, wherein said isolated nucleic acid sequence targets a lung cell.

Embodiment 4. The pharmaceutical composition of embodiment 1, wherein said isolated nucleic acid sequence targets a pancreatic cell.

Embodiment 5. The pharmaceutical composition of embodiment 1, wherein said isolated nucleic acid sequence targets a white blood cell.

Embodiment 6. The pharmaceutical composition of embodiment 1, wherein said isolated nucleic acid sequence crosses a nuclear membrane of said cell upon administration to said cell.

Embodiment 7. The pharmaceutical composition of embodiment 6, wherein said isolated nucleic acid sequence has at least 80% identity to any one of SEQ ID NO: 203-SEQ ID NO: 277, or SEQ ID NO: 282.

Embodiment 8. The pharmaceutical composition of embodiment 7, wherein said isolated nucleic acid sequence integrates itself into a genome of said subject after crossing the nuclear membrane.

Embodiment 9. The pharmaceutical composition of embodiment 1, wherein said isolated nucleic acid sequence is at least 400 base pairs in length.

Embodiment 10. The pharmaceutical composition of embodiment 1, wherein said isolated nucleic acid sequence is between 400 base pairs and 20,000 base pairs in length.

Embodiment 11. The pharmaceutical composition of embodiment 1, wherein said circulating tumor DNA released by said cancerous cell comprises a transposon.

Embodiment 12. The pharmaceutical composition of embodiment 11, wherein said transposon is a class II transposon.

Embodiment 13. The pharmaceutical composition of embodiment 12, wherein said isolated nucleic acid sequence is derived from said class II transposon.

Embodiment 14. The pharmaceutical composition of embodiment 1, wherein said isolated nucleic acid sequence is part of a nucleic acid construct that comprises at least one additional nucleic acid sequence that is heterologous to said cell.

Embodiment 15. The pharmaceutical composition of embodiment 14, wherein said at least one additional nucleic acid sequence comprises a tissue selective promoter.

Embodiment 16. The pharmaceutical composition of embodiment 14, wherein said at least one additional nucleic acid sequence comprises a sequence that encodes a peptide or protein.

Embodiment 17. The pharmaceutical composition of embodiment 14, wherein said at least one additional nucleic acid sequence comprises an integration signal sequence for incorporation into a target genome.

Embodiment 18. The pharmaceutical composition of embodiment 14, wherein said at least one additional nucleic acid sequence comprises a guide sequence for targeting said cell.

Embodiment 19. The pharmaceutical composition of embodiment 14, wherein said at least one additional nucleic acid sequence comprises a sequence that encodes a peptide or a protein.

Embodiment 20. The pharmaceutical composition of embodiment 19, wherein said peptide or said protein encodes a tumor suppressor peptide or a tumor suppressor protein.

Embodiment 21. The pharmaceutical composition of embodiment 20, wherein said tumor suppressor peptide or said tumor suppressor protein is a multiple myeloma tumor suppressor gene.

Embodiment 22. The pharmaceutical composition of embodiment 20, wherein said tumor suppressor peptide or said tumor suppressor protein is a pancreatic cancer tumor suppressor gene.

Embodiment 23. The pharmaceutical composition of embodiment 20, wherein said tumor suppressor peptide or said tumor suppressor protein is a lung cancer tumor suppressor gene.

Embodiment 24. The pharmaceutical composition of embodiment 20, wherein said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53.

Embodiment 25. The pharmaceutical composition of embodiment 19, wherein said peptide or said protein encodes an antigenic protein.

Embodiment 26. The pharmaceutical composition of embodiment 25, wherein said antigenic protein is translated specifically in said cell upon administration to said subject.

Embodiment 27. The pharmaceutical composition of embodiment 1, wherein said composition further comprises a cargo.

Embodiment 28. The pharmaceutical composition of embodiment 27, wherein said cargo is a fluorophore or a radioisotope.

Embodiment 29. The pharmaceutical composition of embodiment 27, wherein said cargo is a therapeutic drug.

Embodiment 30. The pharmaceutical composition of embodiment 27, wherein said formulation comprises a nanoparticle or cationic polymer.

Embodiment 31. In some embodiments, the disclosure provides a gene delivery system comprising: a) a first region comprising a 3' nucleic acid sequence, wherein said 3' cell nucleic acid sequence is derived from a transposon isolated from a cancer cell, b) a second region comprising a gene coding sequence; and c) a third region comprising a 5' nucleic acid sequence, wherein said 5' cell nucleic acid sequence is derived from said transposon isolated from said cancer cell.

Embodiment 32. The gene delivery system of embodiment 31, wherein said 3' cell nucleic acid sequence or said 5' nucleic acid sequence derived from said transposon comprises a cell targeting signal.

Embodiment 33. The gene delivery system of embodiment 31, wherein said 3' cell nucleic acid sequence or said 5' nucleic acid sequence derived from said transposon comprises a cell integration signal.

Embodiment 34. The gene delivery system of embodiment 31, wherein said first region further comprises an optional guide sequence.

Embodiment 35. The gene delivery system of embodiment 31, wherein said second region further comprises a tissue specific promoter driving the expression of said gene of interest.

Embodiment 36. In some embodiments, the disclosure provides an isolated nucleic acid comprising a sequence derived from a circulating tumor DNA released by a cancerous cell wherein said isolated nucleic acid sequence is taken up by a cell that is of the same cell type as said cancerous cell.

Embodiment 37. The isolated nucleic acid of embodiment 36, wherein said isolated nucleic acid is not taken up by a second cell type that is not of the same cell type as said cancerous cell.

Embodiment 38. The isolated nucleic acid of embodiment 36, wherein said isolated nucleic acid crosses the nuclear membrane of said cell.

Embodiment 39. The isolated nucleic acid of embodiment 36, wherein said isolated nucleic acid is taken up by a lung cell.

Embodiment 40. The isolated nucleic acid of embodiment 36, wherein said isolated nucleic acid is taken up by a pancreatic cell.

Embodiment 41. The isolated nucleic acid of embodiment 36, wherein said isolated nucleic acid is taken up by a lung cell.

Embodiment 42. The isolated nucleic acid of embodiment 36, wherein said isolated nucleic acid has a sequence that has at least 80% similarity to SEQ ID NO: 1-SEQ ID NO: 277, or SEQ ID NO: 282.

Embodiment 43. The isolated nucleic acid of embodiment 42, wherein said isolated nucleic acid has a sequence that has at least 80% similarity to SEQ ID NO: 1-SEQ ID NO: 277, or SEQ ID NO: 282 and contains at least one substitution modification relative to SEQ ID NO: 1-SEQ ID NO: 277, or SEQ ID NO: 282.

Embodiment 44. In some embodiments, the disclosure provides a vector comprising the isolated nucleic acid sequence of embodiment 36 and a heterologous nucleic acid sequence.

Embodiment 45. In some embodiments, the disclosure provides a library of two or more isolated nucleic acid sequences comprising two or more isolated nucleic acid sequence of embodiment 36.

Embodiment 46. In some embodiments, the disclosure provides an isolated nucleic acid comprising a sequence derived from a circulating tumor DNA released by a cancerous cell wherein said isolated nucleic acid sequence crosses the nuclear membrane of a cell that is of the same cell type as said cancerous cell and integrates itself into a genome of said cell.

Embodiment 47. The isolated nucleic acid of embodiment 46, wherein said isolated nucleic acid is not taken up by a second cell type that is not of the same cell type as said cancerous cell.

Embodiment 48. The isolated nucleic acid of embodiment 46, wherein said isolated nucleic acid integrates itself into a genome of a lung cell.

Embodiment 49. The isolated nucleic acid of embodiment 46, wherein said isolated nucleic acid integrates itself into a genome of a pancreatic cell.

Embodiment 50. The isolated nucleic acid of embodiment 46, wherein said isolated nucleic acid integrates itself into a genome of a lung cell.

Embodiment 51. The isolated nucleic acid of embodiment 46, wherein said isolated nucleic acid has a sequence that has at least 80% similarity to SEQ ID NO: 203-SEQ ID NO: 277, or SEQ ID NO: 282.

Embodiment 52. The isolated nucleic acid of embodiment 51, wherein said isolated nucleic acid has a sequence that has at least 80% similarity to SEQ ID NO: 203-SEQ ID NO: 277, or SEQ ID NO: 282 and contains at least one substitution modification relative to SEQ ID NO: 203-SEQ ID NO: 277, or SEQ ID NO: 282.

Embodiment 53. In some embodiments, the present disclosure provides a vector comprising the isolated nucleic acid sequence of embodiment 46 and a heterologous nucleic acid sequence.

Embodiment 54. In some embodiments, the present disclosure provides a library of two or more isolated nucleic acid sequences comprising two or more human nucleic acid transposon sequences of embodiment 46.

Embodiment 55. In some embodiments, the present disclosure provides a method comprising: a) obtaining a biological sample of a subject; b) detecting whether a nucleic acid sequence that has at least 80% sequence identity to SEQ ID NO: 1-SEQ ID NO: 277, or SEQ ID NO: 282 is present in said biological sample by contacting a probe with said biological sample and detecting hybridization between the probe and the nucleic acid sequence; and c) characterizing a health state of said biological sample of said subject based on whether said nucleic acid is detected by said hybridization.

Embodiment 56. The method of embodiment 55, wherein said nucleic acid is a deoxyribonucleic acid.

Embodiment 57. The method of embodiment 55, wherein said nucleic acid is a cell-free deoxyribonucleic acid.

Embodiment 58. The method of embodiment 55, wherein said nucleic acid sequence is at least 400 base pairs in length.

Embodiment 59. The method of embodiment 58, wherein said nucleic acid sequence is between 400 base pairs and 20,000 base pairs in length.

Embodiment 60. The method of embodiment 55, wherein said health state is a cancer.

Embodiment 61. The method of embodiment 60, wherein said cancer is a pancreatic cancer.

Embodiment 62. The method of embodiment 60, wherein said cancer is a myeloma.

Embodiment 63. The method of embodiment 55, wherein said biological sample is urine, saliva, or sputum.

Embodiment 64. The method of embodiment 55, wherein said biological sample is a histology tissue.

Embodiment 65. The method of embodiment 55, wherein said probe is complementary to a region of said nucleic acid sequence.

Embodiment 66. In some embodiments, the present disclosure provides a method comprising: a) obtaining a biological sample of a subject; b) quantifying a level of a nucleic acid sequence that has at least 80% sequence identity to SEQ ID NO: 1-SEQ ID NO: 277, or SEQ ID NO: 282 in said biological sample by one or more processes selected from: reverse transcription, polynucleotide amplification, or sequencing; c) comparing, in a computer system, said quantified level of said nucleic acid sequence to a reference; and d) characterizing a health state of said biological sample of said subject based on whether said nucleic acid is detected by said one or more processes.

Embodiment 67. The method of embodiment 66, wherein said nucleic acid is a deoxyribonucleic acid.

Embodiment 68. The method of embodiment 66, wherein said nucleic acid is a cell-free deoxyribonucleic acid.

Embodiment 69. The method of embodiment 66, wherein said nucleic acid sequence is at least 400 base pairs in length.

Embodiment 70. The method of embodiment 66, wherein said nucleic acid sequence is between 400 base pairs and 20,000 base pairs in length.

Embodiment 71. The method of embodiment 66, wherein said health state is a cancer.

Embodiment 72. The method of embodiment 71, wherein said cancer is a pancreatic cancer.

Embodiment 73. The method of embodiment 71, wherein said cancer is a myeloma.

Embodiment 74. The method of embodiment 71, wherein said cancer is a lung cancer.

Embodiment 75. The method of embodiment 66, wherein said biological sample is urine, saliva, or sputum.

Embodiment 76. The method of embodiment 66, wherein said biological sample is a histology tissue.

Embodiment 77. In some embodiments, the present disclosure provides a method for treating a cancer, the method comprising: administering an effective amount of a pharmaceutical composition comprising a nucleic acid sequence derived from a human transposon sequence and a cargo to a subject suffering from said cancer, which composition is formulated for administration to a subject.

Embodiment 78. The method of embodiment 77, wherein the cancer is a lung cancer.

Embodiment 79. The method of embodiment 77, wherein the cancer is a multiple myeloma.

Embodiment 80. The method of embodiment 77, wherein the cancer is a pancreatic cancer.

Embodiment 81. The method of embodiment 77, wherein said isolated nucleic acid sequence crosses a nuclear membrane of said cell upon administration to said cell.

Embodiment 82. The method of embodiment 77, wherein said nucleic acid sequence derived from said human transposon has at least 80% identity to any one of SEQ ID NO: 1-SEQ ID NO: 277, or SEQ ID NO: 282.

Embodiment 83. The method of embodiment 77, wherein said nucleic acid sequence derived from said human transposon integrates itself into a genome of said subject after crossing the nuclear membrane.

Embodiment 84. The method of embodiment 77, wherein said nucleic acid sequence derived from said human transposon is at least 400 base pairs in length.

Embodiment 85. The method of embodiment 77, wherein said nucleic acid sequence derived from said human transposon is between 400 base pairs and 20,000 base pairs in length.

Embodiment 86. The method of embodiment 77, wherein said human transposon is a class II transposon.

Embodiment 87. The method of embodiment 77, wherein said nucleic acid sequence derived from said human transposon is part of a nucleic acid construct that comprises at least one additional nucleic acid sequence that is heterologous to said cell.

Embodiment 88. The method of embodiment 87, wherein said at least one additional nucleic acid sequence comprises a tissue selective promoter.

Embodiment 89. The method of embodiment 87, wherein said at least one additional nucleic acid sequence comprises a sequence that encodes a peptide or protein.

Embodiment 90. The method of embodiment 87, wherein said at least one additional nucleic acid sequence comprises an integration signal sequence for incorporation into a target genome.

Embodiment 91. The method of embodiment 87, wherein said at least one additional nucleic acid sequence comprises a guide sequence for targeting said cell.

Embodiment 92. The method of embodiment 87, wherein said at least one additional nucleic acid sequence comprises a sequence that encodes a peptide or a protein.

Embodiment 93. The method of embodiment 92, wherein said peptide or said protein encodes a tumor suppressor peptide or a tumor suppressor protein.

Embodiment 94. The method of embodiment 93, wherein said tumor suppressor peptide or said tumor suppressor protein is a multiple myeloma tumor suppressor gene.

Embodiment 95. The method of embodiment 93, wherein said tumor suppressor peptide or said tumor suppressor protein is a pancreatic cancer tumor suppressor gene.

Embodiment 96. The method of embodiment 93, wherein said tumor suppressor peptide or said tumor suppressor protein is a lung cancer tumor suppressor gene.

Embodiment 97. The method of embodiment 93, wherein said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53.

Embodiment 98. The method of embodiment 89, wherein said peptide or said protein encodes an antigenic protein.

Embodiment 99. The method of embodiment 98, wherein said antigenic protein is translated specifically in said cell upon administration to said subject.

Embodiment 100. The method of embodiment 77, wherein said composition further comprises a cargo.

Embodiment 101. The method of embodiment 100, wherein said cargo is a fluorophore or a radioisotope.

Embodiment 102. The method of embodiment 100, wherein said cargo is a therapeutic drug.

Embodiment 103. The method of embodiment 77, wherein said formulation comprises a nanoparticle or cationic polymer.

Embodiment 104. In some embodiments, the present disclosure provides a pharmaceutical composition comprising a therapeutically effective amount of a nucleic acid construct comprising a) a first deoxyribonucleic acid sequence that directs a migration of said nucleic acid construct to a pre-selected tissue in vivo; and b) a second deoxyribonucleic acid sequence that directs an integration of a region of said nucleic acid construct into a genome of a cell from said pre-selected tissue in vivo; which composition is formulated for administration to a subject.

Embodiment 105. The pharmaceutical composition of embodiment 104, wherein said first deoxyribonucleic acid sequence is from a same cell type as said cell from said pre-selected tissue.

Embodiment 106. The pharmaceutical composition of embodiment 104, wherein said subject is a human.

Embodiment 107. The pharmaceutical composition of embodiment 104, wherein said first deoxyribonucleic acid sequence migrates to a white blood cell.

Embodiment 108. The pharmaceutical composition of embodiment 104, wherein said first deoxyribonucleic acid sequence migrates to a pancreatic cell.

Embodiment 109. The pharmaceutical composition of embodiment 104, wherein said first deoxyribonucleic acid sequence migrates to lung cell.

Embodiment 110. The pharmaceutical composition of embodiment 104, wherein said nucleic acid construct crosses a nuclear membrane of said cell from said pre-selected tissue when administered to said subject.

Embodiment 111. The pharmaceutical composition of embodiment 104, wherein said first deoxyribonucleic acid sequence has at least 90% identity to at least 12 bases of any one of SEQ ID NO: 203-SEQ ID NO: 277 and SEQ ID NO: 282.

Embodiment 112. The pharmaceutical composition of embodiment 104, wherein said first deoxyribonucleic acid sequence is at least 400 base pairs in length.

Embodiment 113. The pharmaceutical composition of embodiment 104, wherein said first deoxyribonucleic acid sequence is between 400 base pairs and 20,000 base pairs in length.

Embodiment 114. The pharmaceutical composition of embodiment 104, wherein said second deoxyribonucleic acid sequence has at least 90% homology to a transposon sequence.

Embodiment 115. The pharmaceutical composition of embodiment 114, wherein said transposon is a class II transposon.

Embodiment 116. The pharmaceutical composition of embodiment 105, wherein said class II transposon integrates itself into said genome of said cell from said pre-selected tissue via horizontal gene transfer.

Embodiment 117. The pharmaceutical composition of embodiment 104, wherein said nucleic acid construct that comprises at least one additional deoxyribonucleic nucleic acid sequence.

Embodiment 118. The pharmaceutical composition of embodiment 117, wherein said at least one additional deoxyribonucleic nucleic acid sequence comprises a tissue selective promoter.

Embodiment 119. The pharmaceutical composition of embodiment 117, wherein said at least one additional deoxyribonucleic nucleic acid sequence comprises a second integration signal for incorporation into said genome.

Embodiment 120. The pharmaceutical composition of embodiment 117, wherein said at least one additional deoxyribonucleic nucleic acid sequence comprises a sequence that encodes a peptide or protein.

Embodiment 121. The pharmaceutical composition of embodiment 120, wherein said at least one additional deoxyribonucleic nucleic acid sequence comprises a sequence for ensuring that said peptide or protein is only expressed in said cell from said pre-selected tissue.

Embodiment 122. The pharmaceutical composition of embodiment 120, wherein said peptide or said protein encodes a tumor suppressor peptide or a tumor suppressor protein.

Embodiment 123. The pharmaceutical composition of embodiment 122, wherein said tumor suppressor peptide or said tumor suppressor protein is a multiple myeloma tumor suppressor gene.

Embodiment 124. The pharmaceutical composition of embodiment 122, wherein said tumor suppressor peptide or said tumor suppressor protein is a pancreatic cancer tumor suppressor gene.

Embodiment 125. The pharmaceutical composition of embodiment 122, wherein said tumor suppressor peptide or said tumor suppressor protein is a lung cancer tumor suppressor gene.

Embodiment 126. The pharmaceutical composition of embodiment 122, wherein said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53.

Embodiment 127. The pharmaceutical composition of embodiment 120, wherein said peptide or said protein encodes an antigenic protein.

Embodiment 128. The pharmaceutical composition of embodiment 127, wherein said antigenic protein is translated specifically in said cell upon administration to said subject.

Embodiment 129. The pharmaceutical composition of embodiment 104, wherein said pharmaceutical composition further comprises a cargo.

Embodiment 130. The pharmaceutical composition of embodiment 127, wherein said cargo is a fluorophore or a radioisotope.

Embodiment 131. The pharmaceutical composition of embodiment 127, wherein said cargo is a therapeutic drug.

Embodiment 132. The pharmaceutical composition of embodiment 127, wherein said cargo is covalently attached to said nucleic acid construct.

Embodiment 133. The pharmaceutical composition of embodiment 127, wherein said formulation comprises a nanoparticle or cationic polymer.

Embodiment 134. In some embodiments, the present disclosure provides a vector comprising a first sequence that has at least 90% identity to at least 12 bases of any one of SEQ ID NO: 203-SEQ ID NO: 277 and SEQ ID NO: 282 and an additional nucleic acid sequence.

Embodiment 135. The vector of embodiment 134, wherein said additional nucleic acid sequence has at least 90% homology to a transposon sequence.

Embodiment 136. The vector of embodiment 135, wherein said transposon is a class II transposon.

Embodiment 137. The vector of embodiment 136, wherein said class II transposon integrates itself into said genome of said cell from said pre-selected tissue via horizontal gene transfer.

Embodiment 138. The vector of embodiment 134, wherein vector comprises at least two additional nucleic acid sequences.

Embodiment 139. The vector of embodiment 138, wherein said at least two additional nucleic acid sequences comprise a tissue selective promoter and a transposon sequence.

Embodiment 140. The vector of embodiment 138, wherein said at least two additional nucleic acid sequences comprise at least two transposon sequences.

Embodiment 141. The vector of embodiment 134, wherein said additional nucleic acid sequence comprises a sequence that encodes a peptide or protein.

Embodiment 142. The vector of embodiment 141, wherein said peptide or said protein is a tumor suppressor peptide or a tumor suppressor protein.

Embodiment 143. The vector of embodiment 142, wherein said tumor suppressor peptide or said tumor suppressor protein is a multiple myeloma tumor suppressor gene.

Embodiment 144. The vector of embodiment 142, wherein said tumor suppressor peptide or said tumor suppressor protein is a pancreatic cancer tumor suppressor gene.

Embodiment 145. The vector of embodiment 142, wherein said tumor suppressor peptide or said tumor suppressor protein is a lung cancer tumor suppressor gene.

Embodiment 146. The vector of embodiment 142, wherein said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53.

Embodiment 146. The vector of embodiment 134, wherein said vector is covalently linked to a cargo.

Embodiment 147. The vector of embodiment 146, wherein said cargo is a fluorophore or a radioisotope.

Embodiment 148. The vector of embodiment 146, wherein said cargo is a therapeutic drug.

Embodiment 149. In some embodiments, the present disclosure provides a library of two or more vectors of embodiment 134.

Embodiment 150. In some embodiments, the present disclosure provides a method for treating a cancer, the method comprising: administering an effective amount of a nucleic acid construct comprising a nucleic acid sequence that directs migration of a cargo to a tissue of a subject suffering from said cancer, which composition is formulated for administration to a subject.

Embodiment 151. The method of embodiment 150, wherein the cancer is a lung cancer.

Embodiment 152. The method of embodiment 150, wherein the cancer is a multiple myeloma.

Embodiment 153. The method of embodiment 150, wherein the cancer is a pancreatic cancer.

Embodiment 154. The method of embodiment 150, wherein said nucleic acid construct crosses a nuclear membrane in a cell of said tissue cell upon administration to said subject.

Embodiment 155. The method of embodiment 150, wherein said nucleic acid sequence that directs migration of said cargo to said tissue has at least 90% identity to at least 12 bases of any one of SEQ ID NO: 203-SEQ ID NO: 277 and SEQ ID NO: 282.

Embodiment 155. The method of embodiment 150, wherein said nucleic acid construct comprises a transposon for integration into a genome of a cell of said tissue.

Embodiment 156. The method of embodiment 155, wherein said transposon is at least 400 base pairs in length.

Embodiment 157. The method of embodiment 155, wherein said transposon is between 400 base pairs and 20,000 base pairs in length.

Embodiment 158. The method of embodiment 155, wherein said transposon is a class II transposon.

Embodiment 159. The method of embodiment 155, wherein said nucleic acid construct comprises at least one additional nucleic acid sequence that is heterologous to a cell of said tissue.

Embodiment 160. The method of embodiment 159, wherein said at least one additional nucleic acid sequence comprises a tissue selective promoter.

Embodiment 161. The method of embodiment 159, wherein said at least one additional nucleic acid sequence comprises a sequence that encodes a peptide or protein.

Embodiment 162. The method of embodiment 159, wherein said at least one additional nucleic acid sequence comprises an integration signal for incorporation into a target genome.

Embodiment 163. The method of embodiment 159, wherein said at least one additional nucleic acid sequence comprises a guide sequence for targeting said cell.

Embodiment 164. The method of embodiment 159, wherein said at least one additional nucleic acid sequence comprises a sequence that encodes a peptide or a protein.

Embodiment 165. The method of embodiment 164, wherein said peptide or said protein encodes a tumor suppressor peptide or a tumor suppressor protein.

Embodiment 166. The method of embodiment 165, wherein said tumor suppressor peptide or said tumor suppressor protein is a multiple myeloma tumor suppressor gene.

Embodiment 167. The method of embodiment 165, wherein said tumor suppressor peptide or said tumor suppressor protein is a pancreatic cancer tumor suppressor gene.

Embodiment 168. The method of embodiment 165, wherein said tumor suppressor peptide or said tumor suppressor protein is a lung cancer tumor suppressor gene.

Embodiment 169. The method of embodiment 165, wherein said tumor suppressor peptide or said tumor suppressor protein is anyone of retinoblastoma susceptibility gene (RB), Wilms' tumors (WT1), neurofibromatosis type-1 (NF1), familial adenomatosis polyposis coli (FAP), von Hippel-Lindau syndrome (VHL), wild-type p53, or super repressor p53.

Embodiment 170. The method of embodiment 164, wherein said peptide or said protein encodes an antigenic protein.

Embodiment 171. The method of embodiment 170, wherein said antigenic protein is translated specifically in a cell of said tissue upon administration to said subject.

Embodiment 172. The method of embodiment 150, wherein said nucleic acid construct is covalently linked to a fluorophore or a radioisotope.

Embodiment 173. The method of embodiment 150, wherein said nucleic acid construct is covalently linked to a therapeutic drug.

Embodiment 174. In some embodiment, the present disclosure provides a method for identifying a nucleic acid sequence that migrates to a tissue or a cell of substantially similar origin comprising: (a) isolating circulating tumor nucleic acids from a biological sample, thereby producing a set of isolated tumor nucleic acids; (b) adding a barcode to said set of isolated circulating tumor nucleic acids, thereby providing a plurality of barcoded tumor nucleic acids; (c) adding at least one barcoded tumor nucleic acid from the plurality of barcoded tumor nucleic acids to a population of cells under conditions that allow for integration of the tissue tropic sequences, thereby producing a cultured population of cells; (d) sequencing the cultured population of cells, thereby producing a plurality of sequencing reads; (e) analyzing the sequencing reads by a computer to identify a presence or an absence of at least one sequencing read from the plurality of sequencing reads comprising the barcode; and (f) analyzing the sequencing reads comprising the barcode to identify the presence or the absence of a sequence that is present on the cultured population of cells but absent in the population of cells, thereby identifying the nucleic acid sequence that migrated to the tissue or the cell of interest.

EXAMPLES

The following examples are included to further describe certain aspects of the present disclosure, and do not be used to limit the scope of the disclosure.

Example 1: Identification of ctDNA that Reflects Tissue Origin in Serum of Patients with Multiple Myeloma (MM), Lung Cancer, and Pancreatic Cancer A viral extraction DNA kit (QIAamp UltraSens Virus Kit, Quiagen, Germantown, Md.), followed by rolling circle amplification (Genomiphi V2, GE Healthcare) was used to extract large DNA fragments (approximately larger than 10 kB) found in circulation of cancer patients. The sequence of mutational landscapes of CD138(+) sorted cells, peripheral blood leukocytes (PBL) cells, and serum samples from 2 patients with Multiple Myeloma (MM) was compared at diagnosis and again after 4 cycles of treatment.

Figure 1:
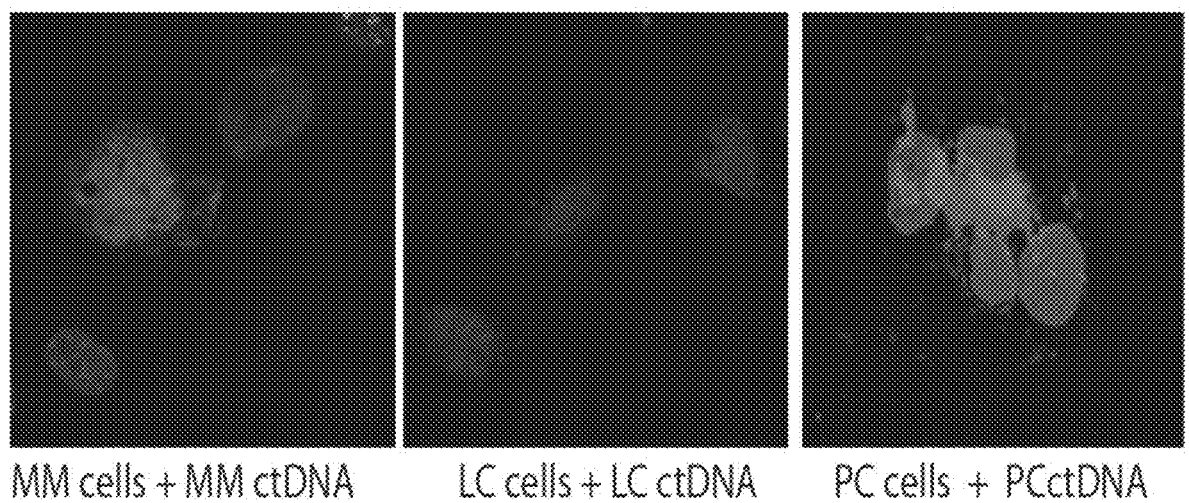
FIG. 1 shows that circulating tumor DNA (ctDNA) comprising specific tumor cell recognition sequences (e.g., Zip Code Sequences, also abbreviated herein as "ZCSs") can cross cell and nuclear membranes in multiple myeloma cells (MM1s cells) (illustrated as MM cells+MM ctDNA), a lung cancer cell line (A549) (illustrated as LC cells+LC ctDNA), and a pancreatic cancer cell lines (SPAC01) (illustrated as PC cells+PC ctDNA).
Figure 2A:
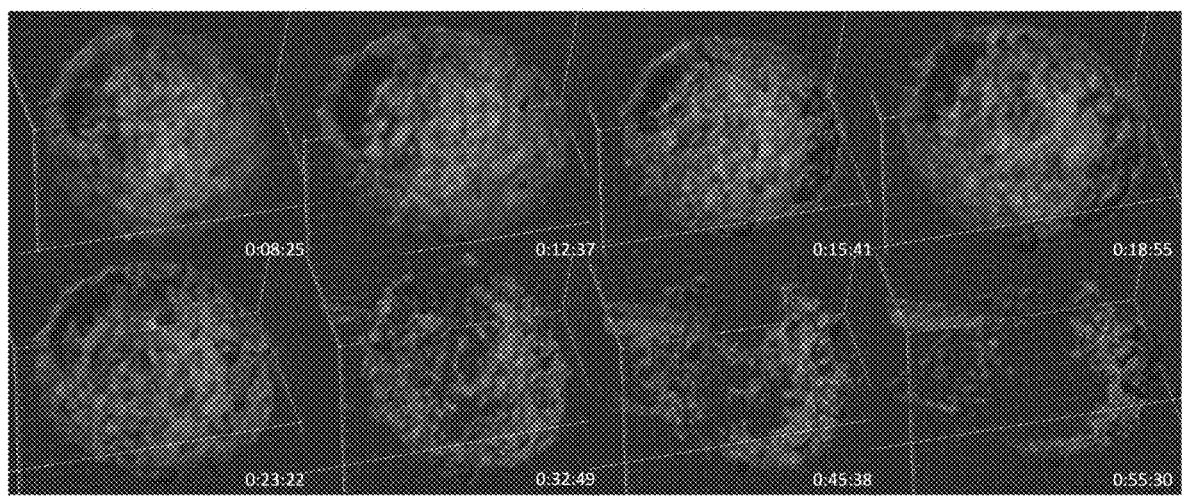
FIG. 2A shows a time course of eight 3D images demonstrating capture and internalization of ctDNA in pancreatic cancer cells.
Figure 2B:
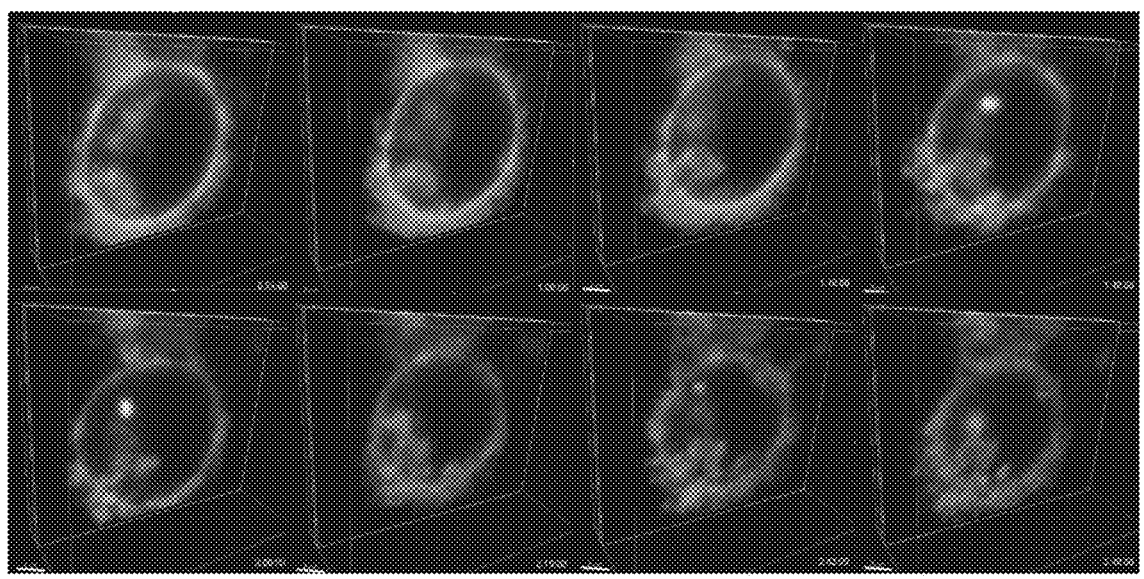
FIG. 2B shows a time course of eight single plane image demonstrating capture and internalization of ctDNA in pancreatic cancer cells.
Figure 2C:
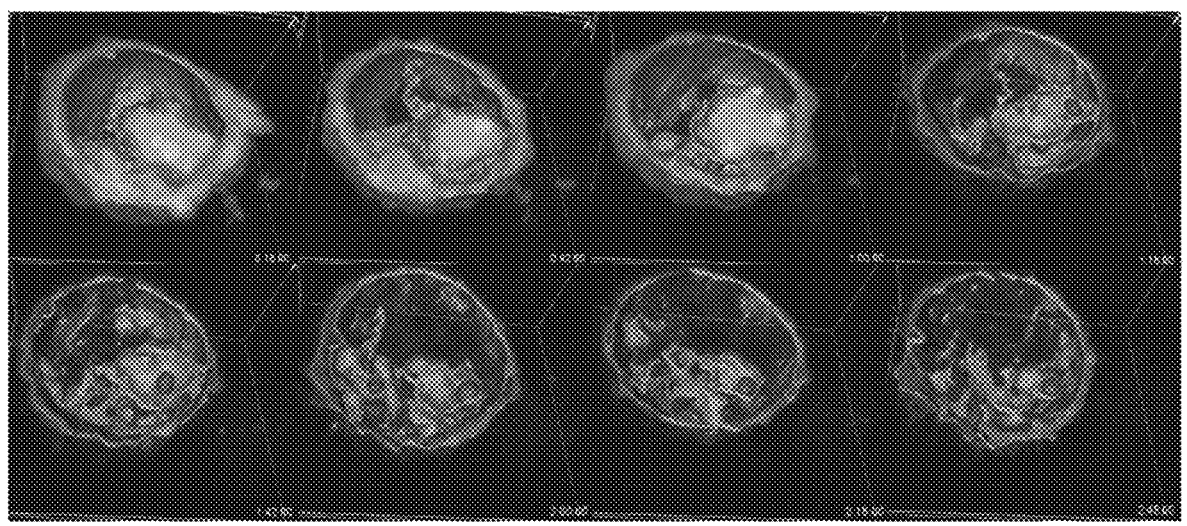
FIG. 2C shows a time course of eight images from a 3D video demonstrating capture and internalization of ctDNA by endocytosis in pancreatic cells.

Samples were further processed and sequenced. Briefly, patients with MM had higher levels of ctDNA in diagnostic samples compared to a control sample from a non-MM patient (i.e., lung or pancreatic cancer) (FIG. 1). With an average depth of coverage of ~50×10$^6$ reads/exon across all samples, pairwise comparisons of base calls and normalized sequence depth at each position were performed. Using a varscan algorithm (http://dkoboldt.github.io/varscan), an average 23,146 coding single nucleotide variants (SNVs) per ctDNA and 24,000 coding SNVs in tumor or PBL were identified, thus characterizing ctDNA as a good source for mutation analysis of the whole exome. Furthermore, a comparison of the number of SNVs from amplified ctDNA and non-amplified DNA from tumor or PBL allowed us to determine ~0.03% of SNVs introduced by our amplification method (the amplification error).

Next, the level of detection (LOD) for somatic mutations in ctDNA was elevated and it was found that 89.8% of the somatic mutations were present in the diagnostic DNA derived from CD138 (+) cells, 7% are germline mutations and 3% were mutations not found on ctDNA.

Example 2: Identification of Cell Recognition and Genome Integration Signals

Figure 6:
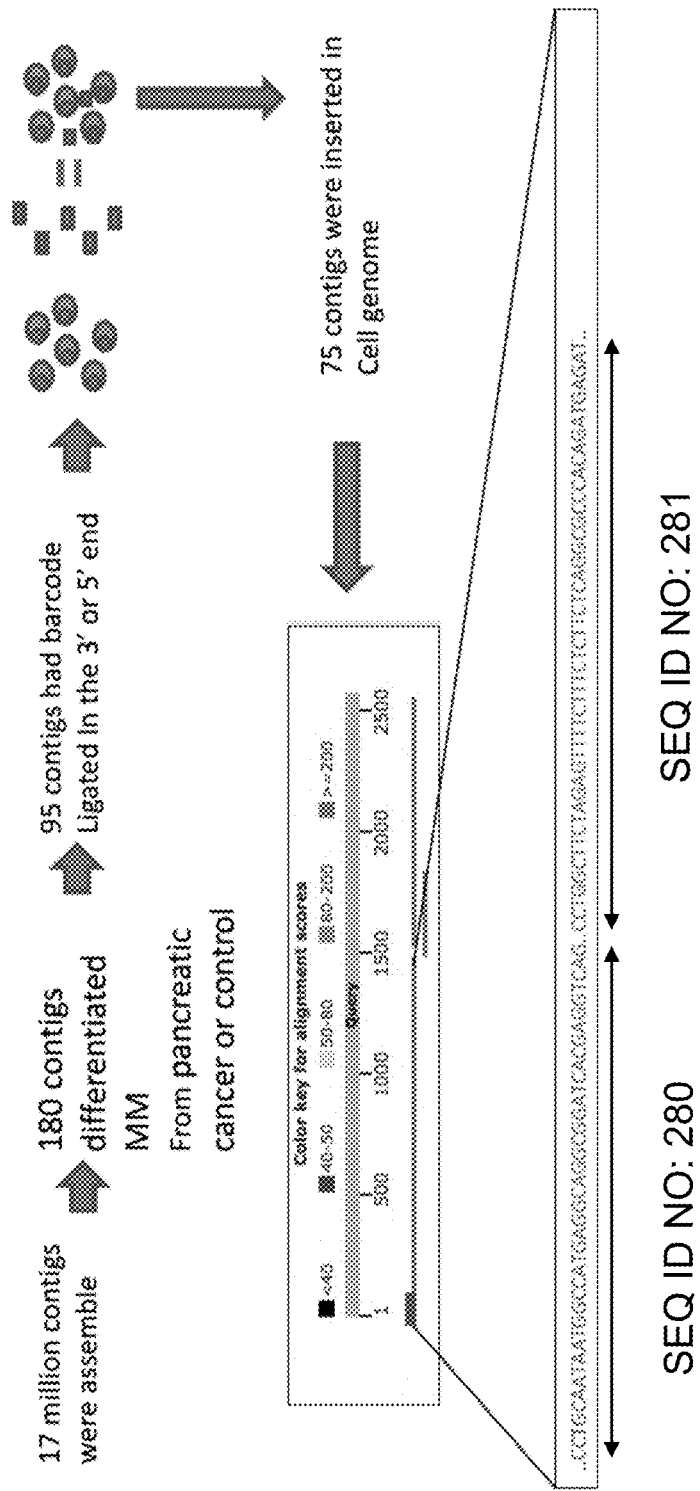
FIG. 6 shows a scheme that illustrates the identification of consensus sequences (contigs).
Figure 7:
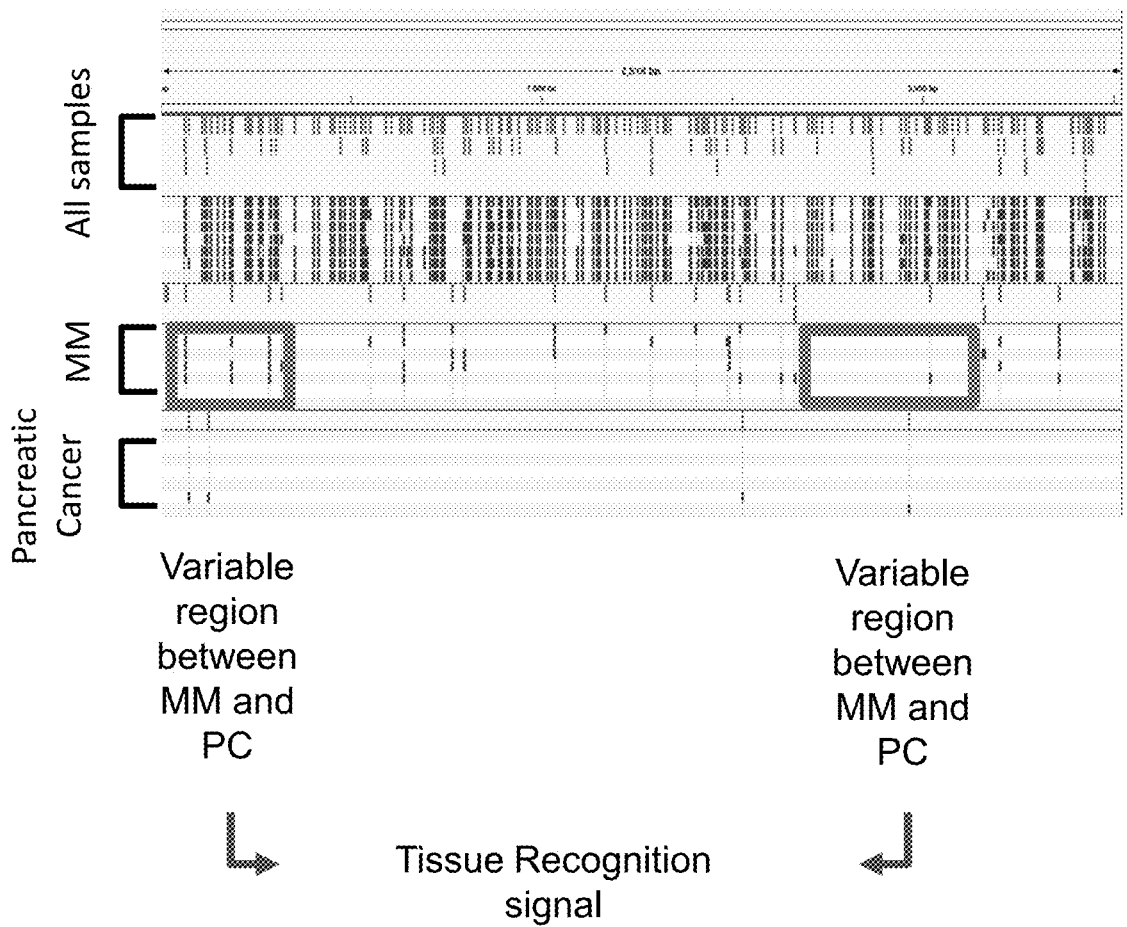
FIG. 7 shows two cell recognition signal sequences. The left red blocks highlight a region for two similar variants that were present in multiple myeloma (MM)-derived ctDNA but not in pancreatic cancer (PC)-derived ctDNA. The red box in the right shows an additional nucleic acid sequence that was detected in MM and PC (control).

This example demonstrates the identification of nucleic acid sequences that enable cell and/or tissue recognition (zip codes) and the integration of the nucleic acid into the genome of a cell upon translocation into the nucleus of the cell (see e.g., FIG. 6-FIG. 7).

The process of identifying cell recognition signals (CRSs) and integration signals (ISs) was performed in parallel experiments. The first experiment (A) was focused on identifying sequences of DNA that are located at the 3' and 5' ends of circulating tumor DNA (ctDNA), such as the circulating tumor DNAs described in Example 1. The second experiment (B) was focused on identifying DNA that is capable of incorporating and integrating into a target cell genome.

A. Identification of the Sequences of DNA Located in the 3' and 5' End of the ctDNA.
Sample Processing.

ctDNA was extracted from 6 multiple myeloma patients, 1 pancreatic cancer patient, and 1 healthy volunteer as control. Subsequently, using an Abm DNA library prep Kit, both ends of the ctDNA were repaired and "A" tailing was performed. Once this process is finalized, specific PACBio sequence barcodes (GCGCTCTGTGTGCT (SEQ ID NO: 279)) were ligated to either end of the nucleic acid sequence. Following these steps, samples were submitted for library preparation using Illumina adapter ligation. Whole genome sequencing (WGS) was performed with a depth coverage of 100 million copies using an Illumina MiSeq instrument.
Analysis of WGS Data.

All reads aligned to the human mitochondrial genome were removed. Reads were subsampled and then assembled using Spades which resulted in a total of 17 million contigs. Assembled contigs were then clustered using CD-HIT at 99% identity. The centroids of clusters that contain all multiple myeloma samples but neither the control nor pancreatic cancer samples were selected which results in 180 remaining contigs that also have PacBio barcode in either the 3' or 5' end.

B. Identification of DNA Sequences Capable of Crossing Cell and Nuclear Membrane and Integrating into the Cell Genome.

Whole genome sequencing was performed using cells from a multiple myeloma cell line, donor ctDNA extracted from multiple myeloma patients (772), and cells from the multiple myeloma cell line that were co-cultured with the extracted ctDNA (772). K-mers were then generated for all the reads in the fastq files from those 3 cell species. The contigs were then further filtered by keeping those that contain k-mers (mapped via bowtie2) that were present in the 772 co-culture, and donor ctDNA samples, but which were not present in the plasma cells sample of the multiple myeloma cell line. After these steps the number of contigs was reduced to 75.
Identification of Cell Recognition Signals.

To this end, reads found in experiment (A) were aligned to the 75 contigs identified in experiment (B) using Burrows-Wheeler Aligner (BWA), and called variants were identified using samtools/bcftools. Subsequently, based on the called variants, consensus sequences (contigs) were identified using bcftools for each sample to find regions of variation that are only specific to multiple myeloma when compared to control or pancreatic cancer. Regions that were not mutated in myeloma but were highly mutated in pancreatic cancer or control ctDNA were labeled as regions of interest to be a potential cell recognition signal.

Figure 3A:
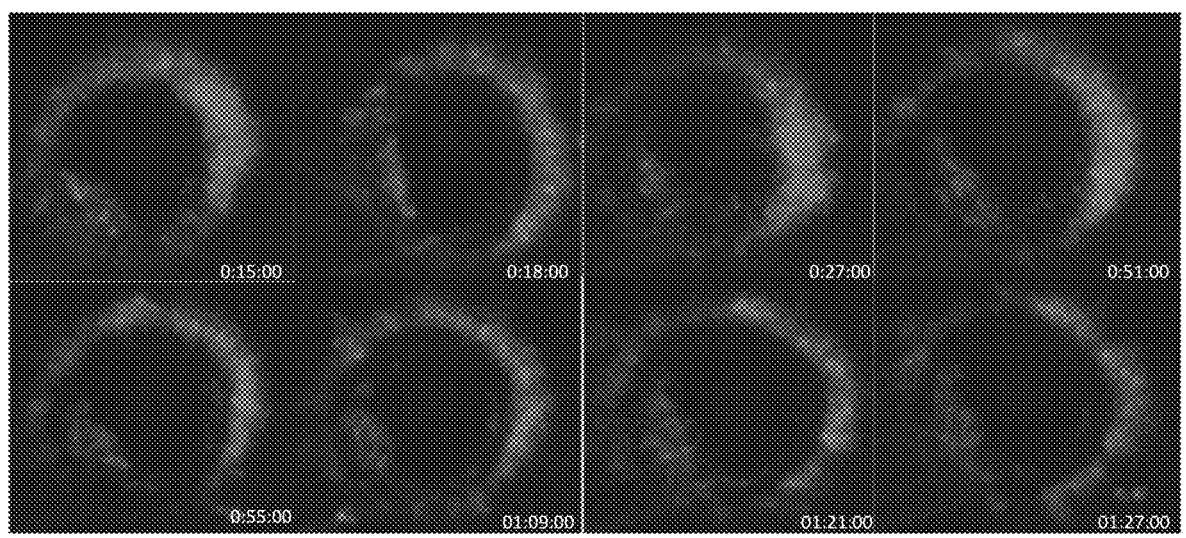
FIG. 3A shows a time course of eight images taken from a single plan video demonstrating nuclear localization of ctDNA in ASPC-1 cells.
Figure 3B:
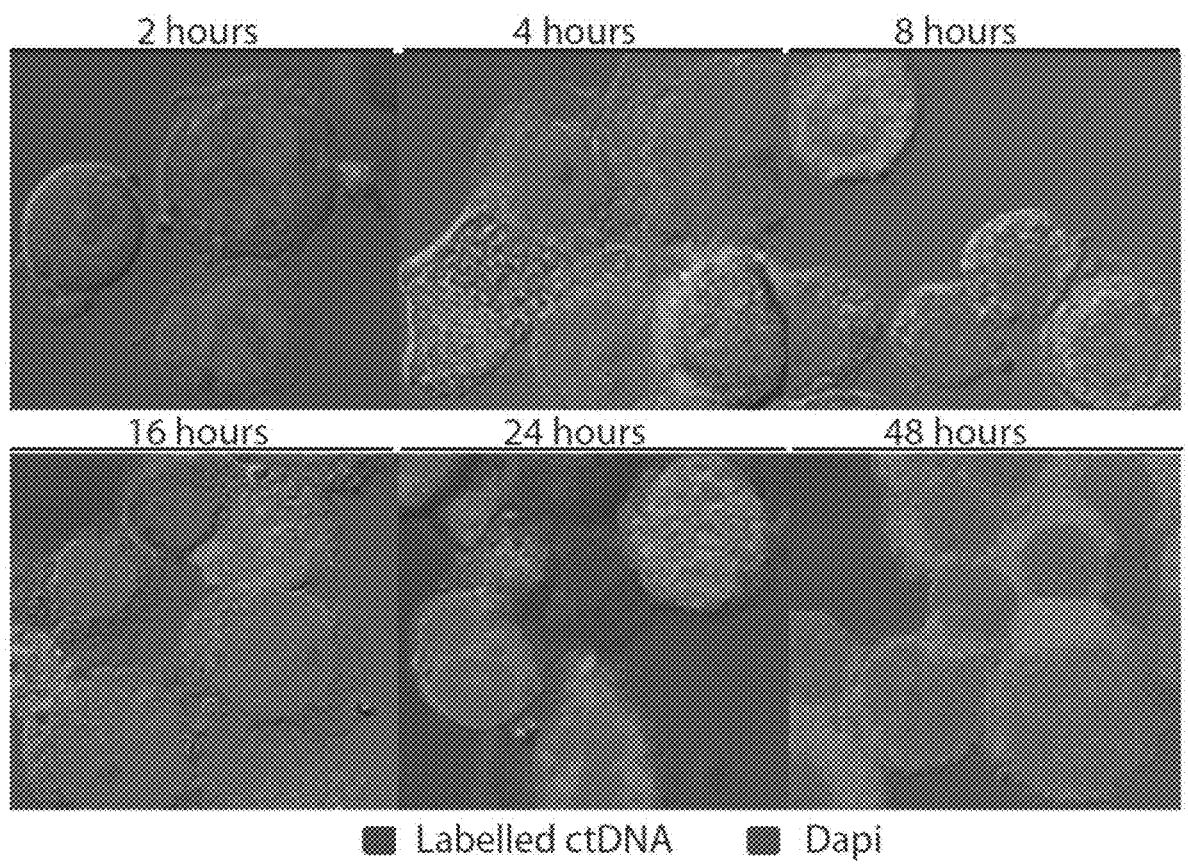
FIG. 3B shows six images taken from a single plan 4-hour time course illustrating nuclear uptake of ctDNA in MM1S cells. Cell membranes were labelled with green fluorescent protein (GFP). Nucleus is labeled with DAPI.

Example 3: Circulating Tumor DNA can Cross Cell and Nuclear Membranes ctDNA from a patient with MM, lung cancer or pancreatic cancer were covalently labeled with CX-rhodamine. After loading 100 ng of ctDNA into the medium, cells were harvested at different time points as indicated in FIG. 3B. In MM, the appearance of ctDNA in the cytoplasm was observed as early as 30 min, and nuclear localization after 24 h, after introduction. In the case of pancreatic cancer cell lines, ctDNA cytoplasmic internalization was observed within 15 minutes and nuclear localization within 50 minutes (FIGS. 2A-2C and FIGS. 3A-3B). Interestingly, our 3D and single plane videos highlight that upon cellular internalization ctDNA is surrounded by GFP (+) cellular membrane, suggesting that ctDNA internalization is mediated by endocytosis.

Example 4: ctDNA Induces DNA Damage

MM cells and its corresponding ctDNA were evaluated and it was observed that ctDNA was not capable of crossing the nuclear membrane of every cell. In some cases, nuclear fragmentation was observed, suggesting that the load of ctDNA introduced into the cytoplasm or nucleus can determine the fate of the target cell. Interestingly, double-stranded DNA (dsDNA) breaks were identified and confirmed by positive H2AX foci in these cells.

Example 5: ctDNA Targets Only Cells that are Similar to its Cell of Origin

This example demonstrates that ctDNA from the same origin as the target cell rapidly penetrates the nuclear membrane of the target cell, whereas the same ctDNA does not enter the nucleus of cells from a different origin (e.g., cell type or tissue).

Labeled ctDNA obtained from patients with MM, lung, or pancreatic cancer was added to culture medium of matching cancer cell lines (i.e., MM, lung, or pancreatic cancer cell lines). As shown previous examples, ctDNA was detected in the nucleus 24 h post-introduction.

However, it was found that when ctDNA was added to a cell line dissimilar to the type of cancer from which the respective ctDNA was derived, the ctDNA failed to translocate to the cytoplasm and nucleus. This suggests the existence of a degree of specificity in cell recognition. Furthermore, and without being bound to any theory, it was assumed that since ctDNA extraction from serum is a very stringent procedure, the sequence or inherent modification of the ctDNA (e.g., DNA methylation pattern) may drive cell recognition as opposed to fragments of cellular membrane (exosomes) or proteins carrying the ctDNA.

Figure 4:
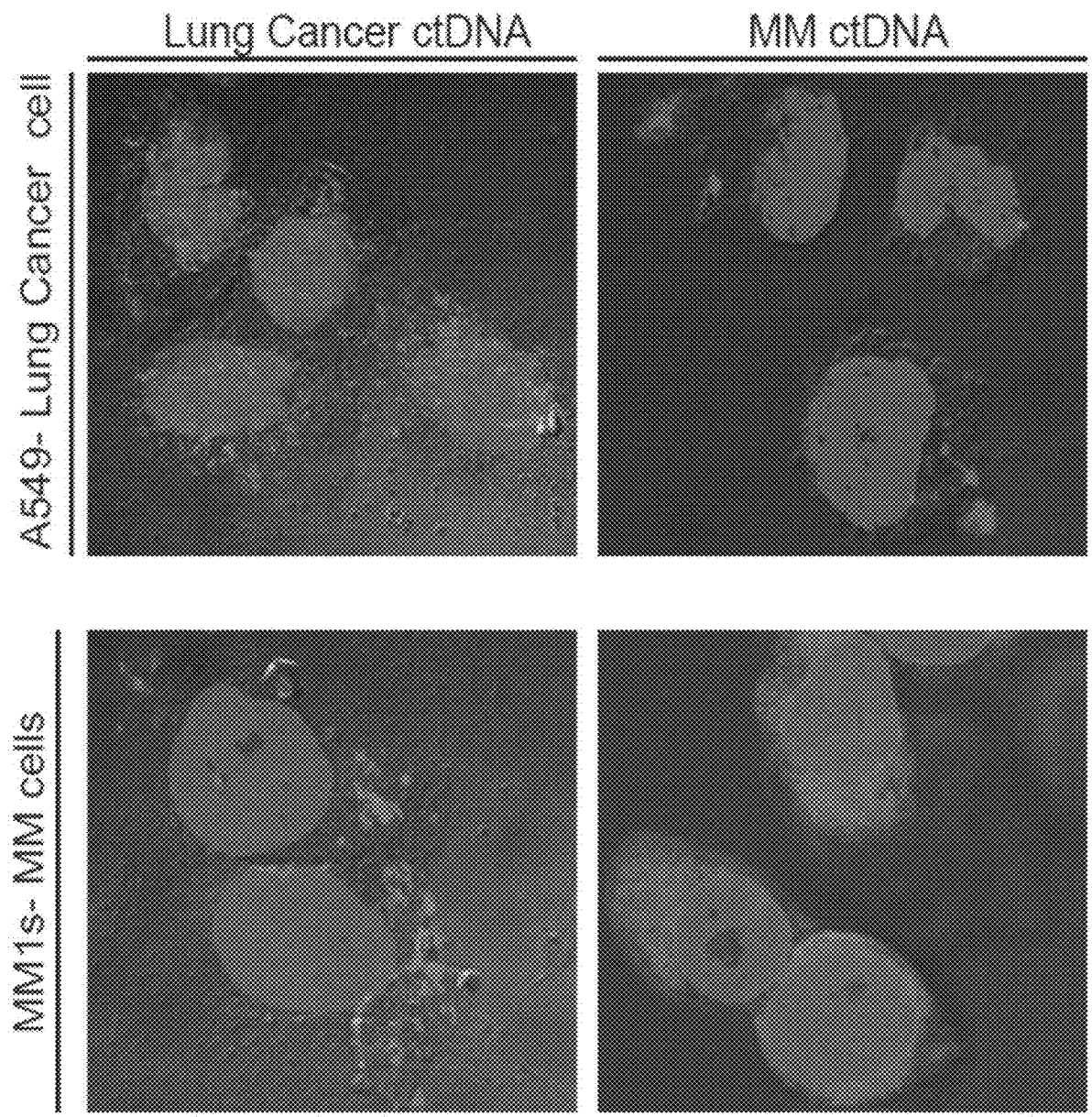
FIG. 4 illustrates A459 (lung cancer) and MM1 (multiple myeloma, MM) cells cultured with labeled ctDNA extracted from a lung cancer or MM patient. The Figure shows that respective ctDNA almost exclusively target cells similar to the ctDNA cell of origin.

Thus, these results demonstrate that ctDNA from MM cells was detected in the nuclei of MM cells, however, the MM-derived ctDNA did not localize within the nuclei of lung or pancreatic cancer cells. Similarly, it was shown that ctDNA from lung cancer patients (adenocarcinoma) was detected in the nuclei of MM cells, however, adenocarcinoma-derived ctDNA did not migrate to or was introduced into MM or pancreatic cancer cells. Lastly, it was shown that ctDNA from pancreatic cancer patients only gets introduced in the cytoplasm and nucleus of pancreatic cancer cells but not into lung cancer or multiple myeloma cell lines (see, e.g., FIG. 1, FIG. 4)

Figure 16A:
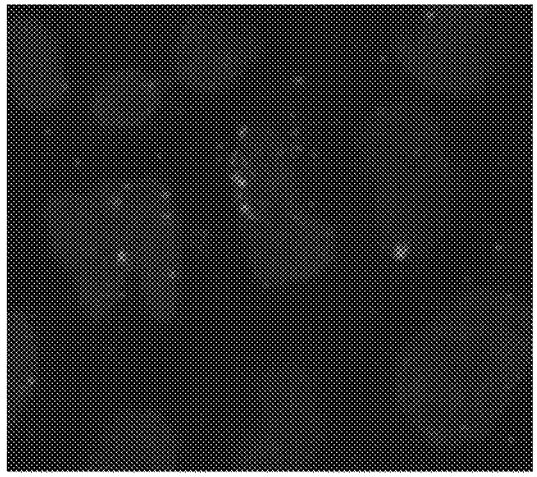
FIG. 16A shows that multiple myeloma (MM)-derived circulating tumor DNA (ctDNA) homes to MM cells in a cell- and tissue specific manner. Regions highlighted in red indicate rhodamine-labeled DNA, blue regions show DAPI staining.
Figure 16B:
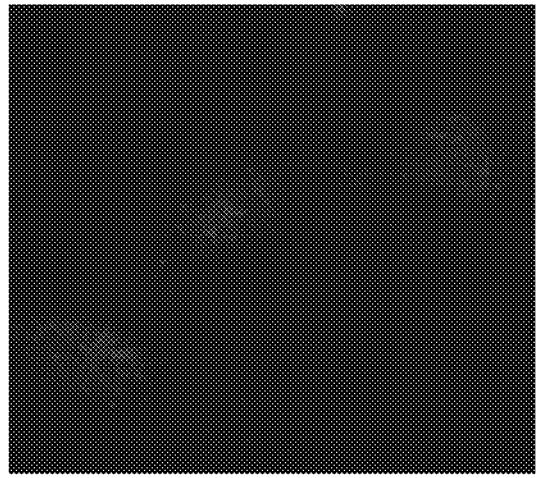
FIG. 16B shows that lung cancer (LC)-derived circulating tumor DNA (ctDNA) homes to LC cells in a cell- and tissue specific manner. Regions highlighted in red indicate rhodamine-labeled DNA, blue regions show DAPI staining.
Figure 16C:
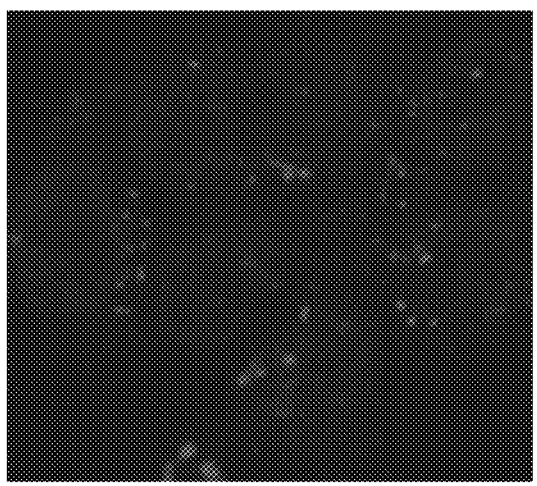
FIG. 16C shows that colon cancer (CC)-derived circulating tumor DNA (ctDNA) homes to CC cells in a cell- and tissue specific manner. Regions highlighted in red indicate rhodamine-labeled DNA, blue regions show DAPI staining.
Figure 16D:
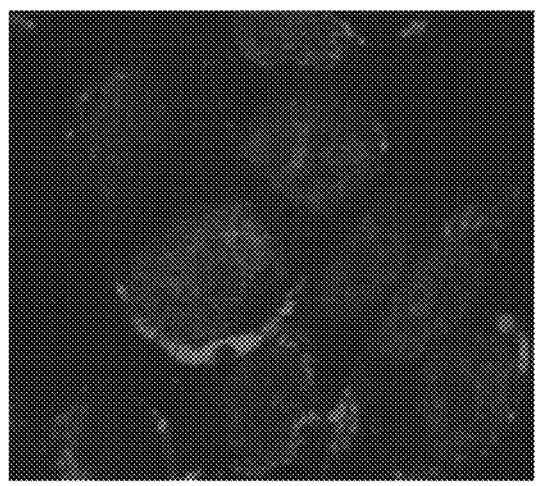
FIG. 16D shows that pancreatic cancer (PC)-derived circulating tumor DNA (ctDNA) homes to PC cells in a cell- and tissue specific manner. Regions highlighted in red indicate rhodamine-labeled DNA, blue regions show DAPI staining.

In an additional experiment, it was demonstrated that tumor-derived ctDNA homes to tumor cells in a tumor-specific manner such that only tumor cells from which the respective ctDNA was derived is targeted. FIG. 16A shows that multiple myeloma (MM)-derived circulating tumor DNA (ctDNA) homes to MM cells in a cell- and tissue specific manner. Regions highlighted in red indicate rhodamine-labeled DNA, blue regions show DAPI staining. FIG. 16B shows that lung cancer (LC)-derived circulating tumor DNA (ctDNA) homes to LC cells in a cell- and tissue specific manner. Regions highlighted in red indicate rhodamine-labeled DNA, blue regions show DAPI staining. FIG. 16C shows that colon cancer (CC)-derived circulating tumor DNA (ctDNA) homes to CC cells in a cell- and tissue specific manner. Regions highlighted in red indicate rhodamine-labeled DNA, blue regions show DAPI staining. FIG. 16D shows that colon cancer (PC)-derived circulating tumor DNA (ctDNA) homes to PC cells in a cell- and tissue specific manner. Regions highlighted in red indicate rhodamine-labeled DNA, blue regions show DAPI staining.

These results demonstrate the surprising finding that tumor-derived ctDNA homes to tumor cells in a tumor-specific manner such that only tumor cells from which the respective ctDNA was derived is targeted. Thus, the Zip Code sequences described herein can be used as cell-, tissue-, and/or organ-specific targeting constructs to deliver therapeutic and/or diagnostic cargo to cells in a highly specific manner.

Cell-Specific Uptake of Zip Code Sequences is not Affected in the Presence of Competing ctDNA An experiment was designed to demonstrate that cell-specific (e.g., cells of origin) uptake of Zip Code Sequences derived from ctDNA of a first tumor type is not affected in the presence of ctDNA derived from a second tumor type.

Figure 17A:
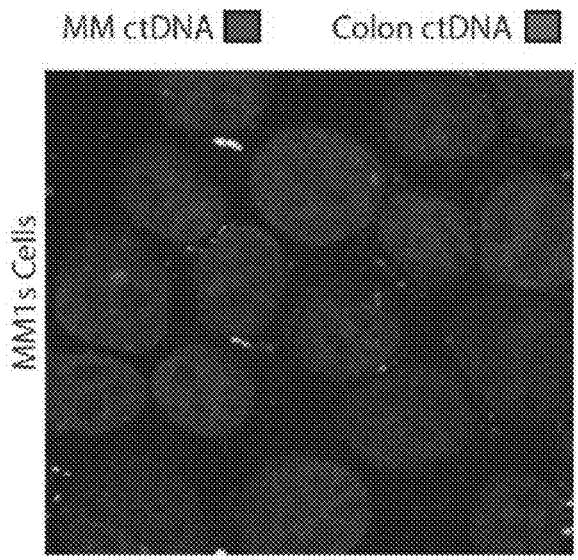
FIG. 17A shows that multiple myeloma (MM)-derived circulating tumor DNA (ctDNA) homes to MM cells in a cell- and tissue specific manner (MM ctDNA shown in red), even in the presence of competing colon cancer (CC) ctDNA (shown in green). Solely MM ctDNA was observed in MM cells but not CC ctDNA.
Figure 17B:
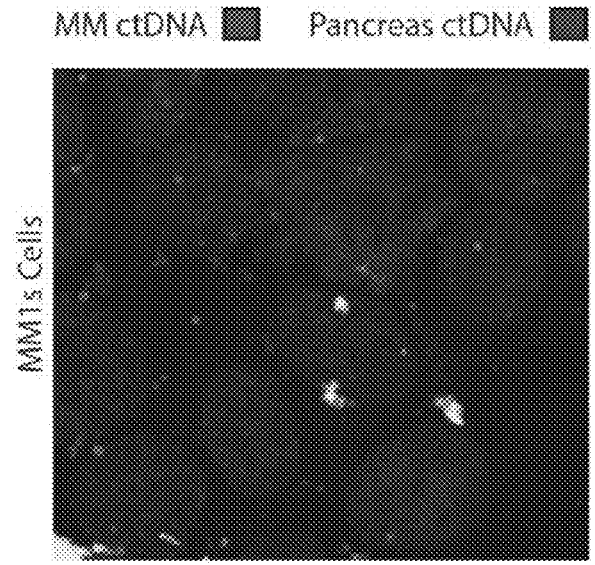
FIG. 17B shows that multiple myeloma (MM)-derived circulating tumor DNA (ctDNA) homes to MM cells in a cell- and tissue specific manner (MM ctDNA shown in red), even in the presence of competing pancreatic cancer (PC) ctDNA (shown in green). Solely MM ctDNA was observed in MM cells but not PC ctDNA.

FIG. 17A shows that multiple myeloma (MM)-derived circulating tumor DNA (ctDNA) homes to MM cells in a cell- and tissue specific manner (MM ctDNA shown in red), even in the presence of competing colon cancer (CC) ctDNA (shown in green). Solely MM ctDNA was observed in MM cells but not CC ctDNA. FIG. 17B shows that multiple myeloma (MM)-derived circulating tumor DNA (ctDNA) homes to MM cells in a cell- and tissue specific manner (MM ctDNA shown in red), even in the presence of competing pancreatic cancer (PC) ctDNA (shown in green). Solely MM ctDNA was observed in MM cells but not PC ctDNA.

Conjugation of Cargo to ctDNA does not Affect Cellular Uptake and Nuclear Localization An experiment was designed to demonstrate that the conjugation of cargo (e.g., molecules such as fluorescent dyes) to ctDNA does not affect the ability of the ctDNA molecule to localize in tumor cells of its origin and further localize in the nucleus of such cells.

Figure 17C:
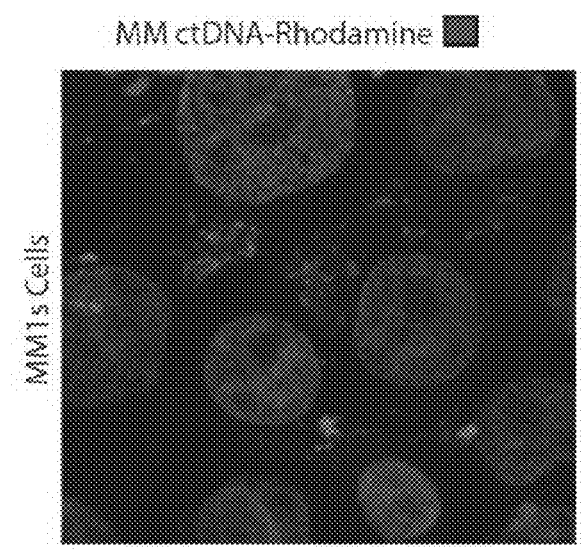
FIG. 17C shows that labeling multiple myeloma (MM)-derived circulating tumor DNA (ctDNA) with the dye rhodamine did not affect the ability of MM-derived ctDNA to accumulate in MM cells in a cell- and tissue specific manner (MM ctDNA-rhodamine constructs shown in red).
Figure 17D:
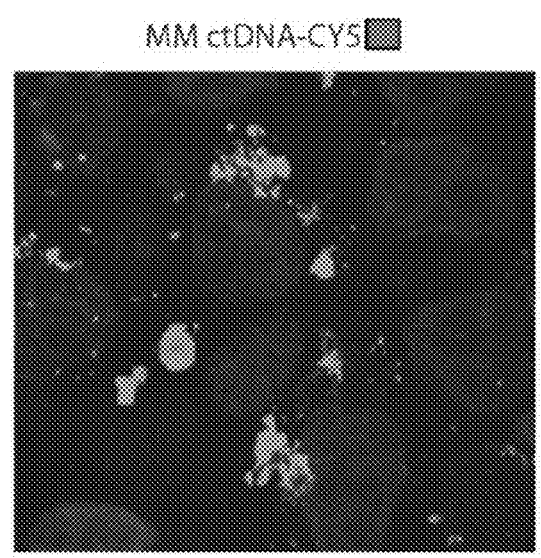
FIG. 17D shows that labeling multiple myeloma (MM)-derived circulating tumor DNA (ctDNA) with the dye Cy5 did not affect the ability of MM-derived ctDNA to accumulate in MM cells in a cell- and tissue specific manner (MM ctDNA-Cy5 constructs shown in green).

FIG. 17C shows that labeling multiple myeloma (MM)-derived circulating tumor DNA (ctDNA) with the dye rhodamine did not affect the ability of MM-derived ctDNA to accumulate in MM cells in a cell- and tissue specific manner (MM ctDNA-rhodamine constructs shown in red). FIG. 17D shows that labeling multiple myeloma (MM)-derived circulating tumor DNA (ctDNA) with the dye Cy5 did not affect the ability of MM-derived ctDNA to accumulate in MM cells in a cell- and tissue specific manner (MM ctDNA-Cy5 constructs shown in green).

Example 6: ctDNA Integrates into the Chromosomes of Plasma Cells

Figure 5A:
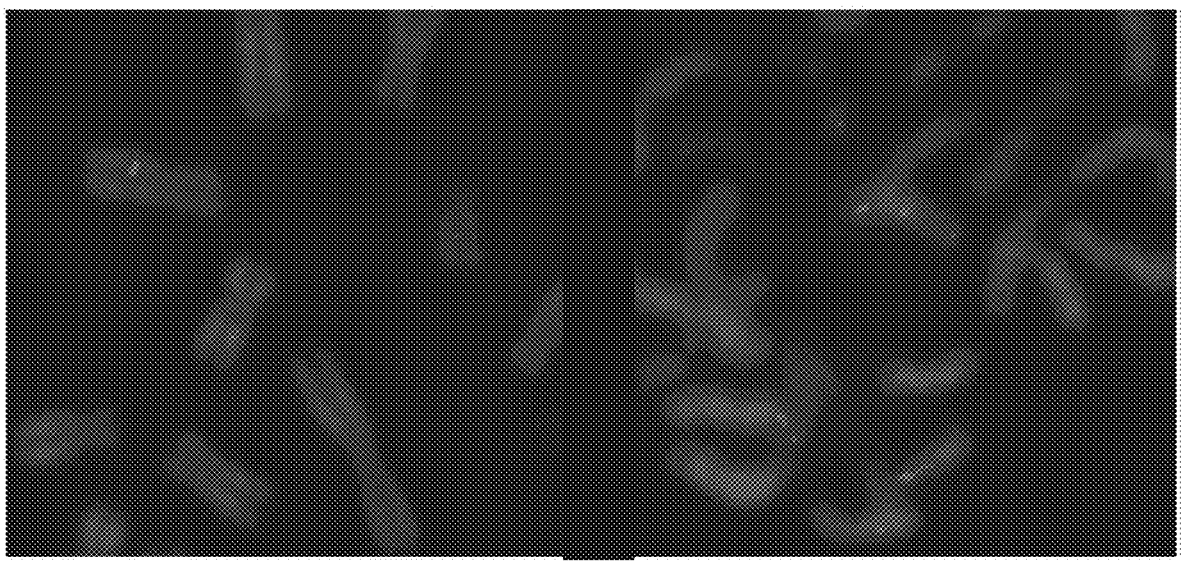
FIG. 5A shows a chromosome spread demonstrating ctDNA integration into plasma cell's chromosomes.

Rodhamine-labelled ctDNA from a first MM patient was placed in culture of plasma cells derived from a different MM patient. After 24 hours, the cell cycles of the cells were arrested with calicheamicin for 1 hour and chromosome spreads were performed. Cellular DNA was then labelled with DAPI staining. As shown in FIG. 5A, ctDNA labelled bands are incorporated into the chromosomes in multiple regions with an average of 5 integration sites per metaphase.

Integration of ctDNA into the target cell genome can require the presence of members of the non-homologous end-join repair system and may function via a transposon mediated mechanism using non-homologous end-join repair.

Figure 5B:
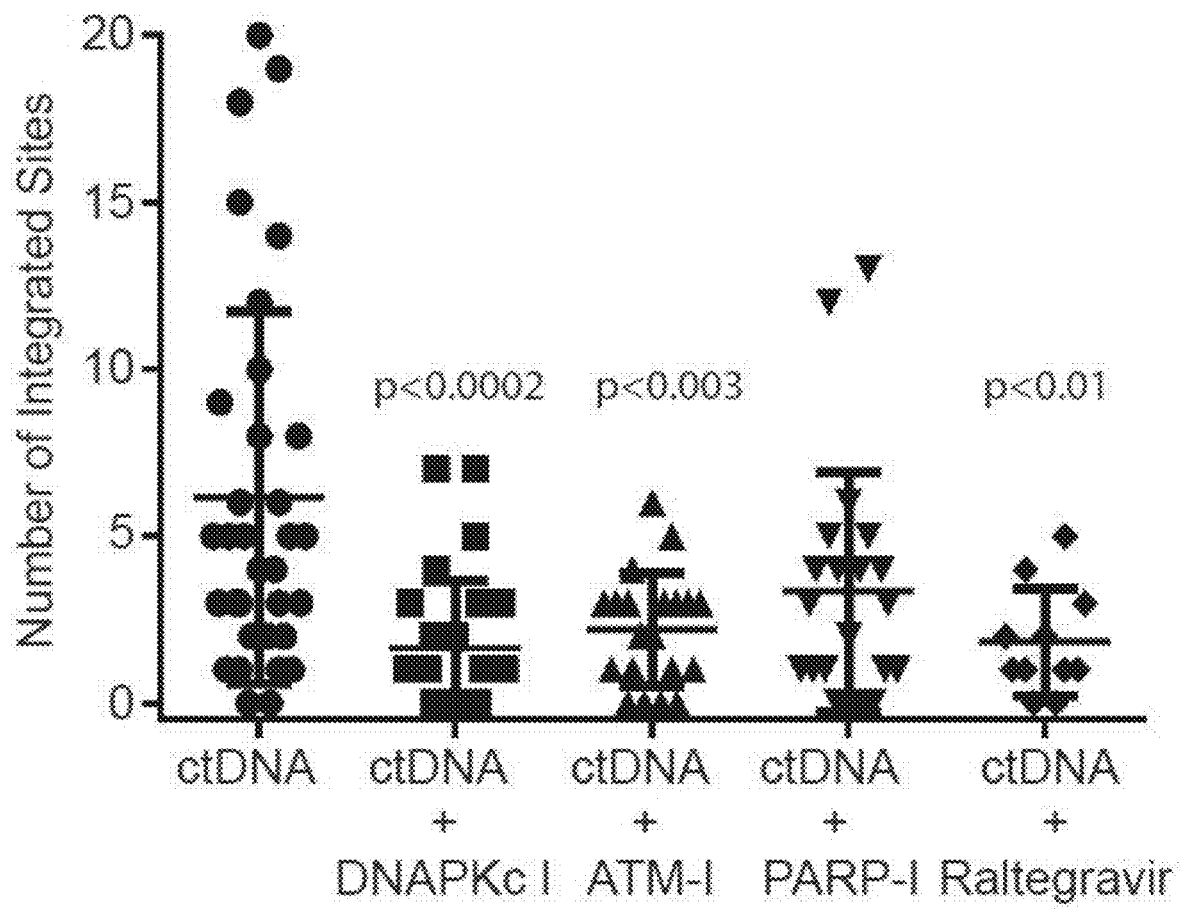
FIG. 5B is a graph showing effect of DNA-dependent protein kinases (e.g., DNAPKcs), Ataxia telangiectasia mutated (ATM), poly-(ADP-ribose) polymerase I (PARP-1), and raltegravir (an integrase inhibitor) on ctDNA integration into chromosomes.
Figure 5C:
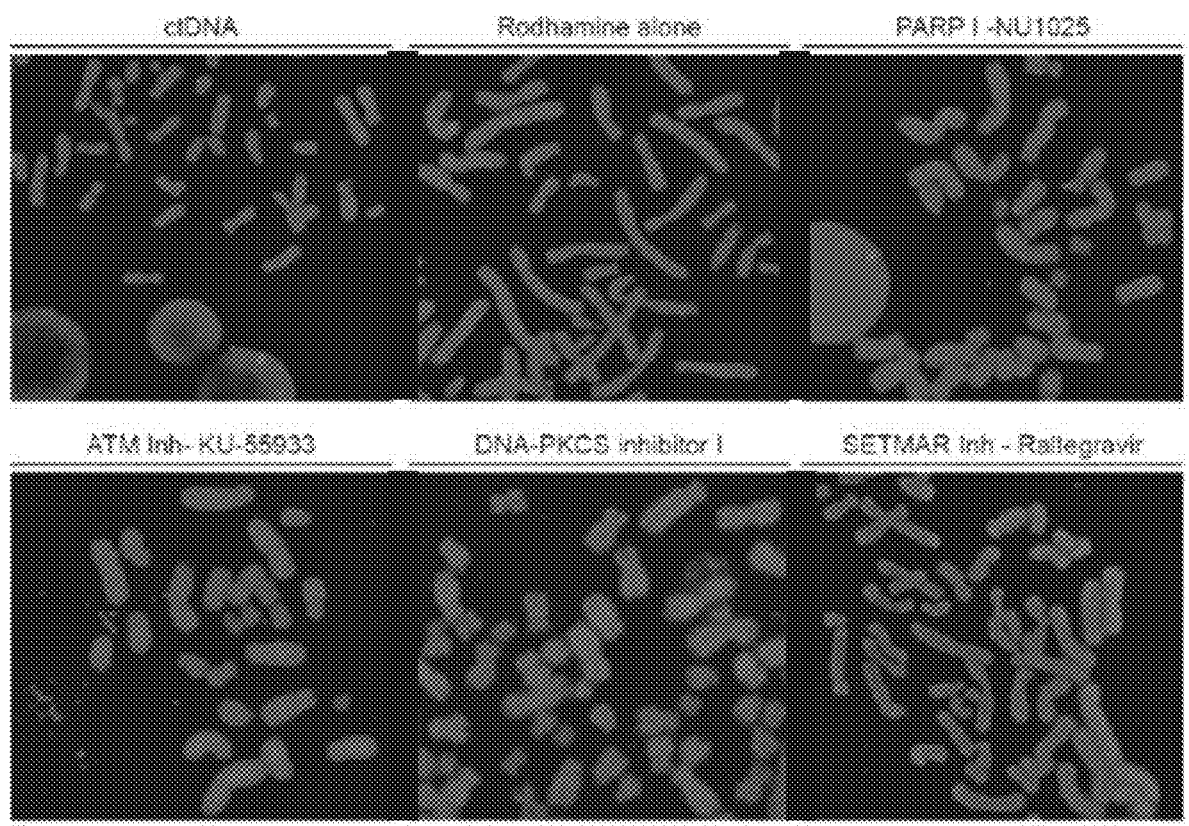
FIG. 5C shows that chromosomal integration of ctDNA can depend on non-homologous end joining (NHEJ) and transposases. Incorporation of labeled ctDNA was reduced significantly when inhibitors of DNAPKcs, ATM, PARP-1, and integrase (raltegravir) were present. A non-significant reduction was observed with PARP-1 inhibition.

For further evaluation, chromosome spreads from MM and lung cancer cell lines were cultured with covalently labeled ctDNA obtained from patients with MM. The results showed incorporation of rhodamine bands into the chromosomes of plasma cells. Incorporation of labeled ctDNA was reduced significantly when DNAPKcs (DNA-PKCS inhibitor I, 200 nM), an ATM (KU-55933) or a Manase SETMAR/integrase (raltegravir, 30 nM) inhibitor was used, and less so when a polyADP ribose polymerase inhibitor (PARP, NU1025, 200 nM) was used (FIG. 5B). In addition, FIG. 5C shows that chromosomal integration of ctDNA can depend on non-homologous end joining (NHEJ) and transposases. Incorporation of labeled ctDNA was reduced significantly when inhibitors of DNAPKcs, ATM, PARP-1, and integrase (raltegravir) were present. A non-significant reduction was observed with PARP-1 inhibition.

It was surprisingly found that that the contig sequence having SEQ ID NO: 99 which was derived from ctDNA inserts into plasma cell's genome during co-culture of ctDNA and plasma cells.

Figure 18:
FIG. 18 shows that MM ctDNA integrated into chromosomal DNA of MM cells. MM ctDNA is shown as red dots. Chromosomal integration of MM ctDNA was validated using sequencing.
Figure 19:
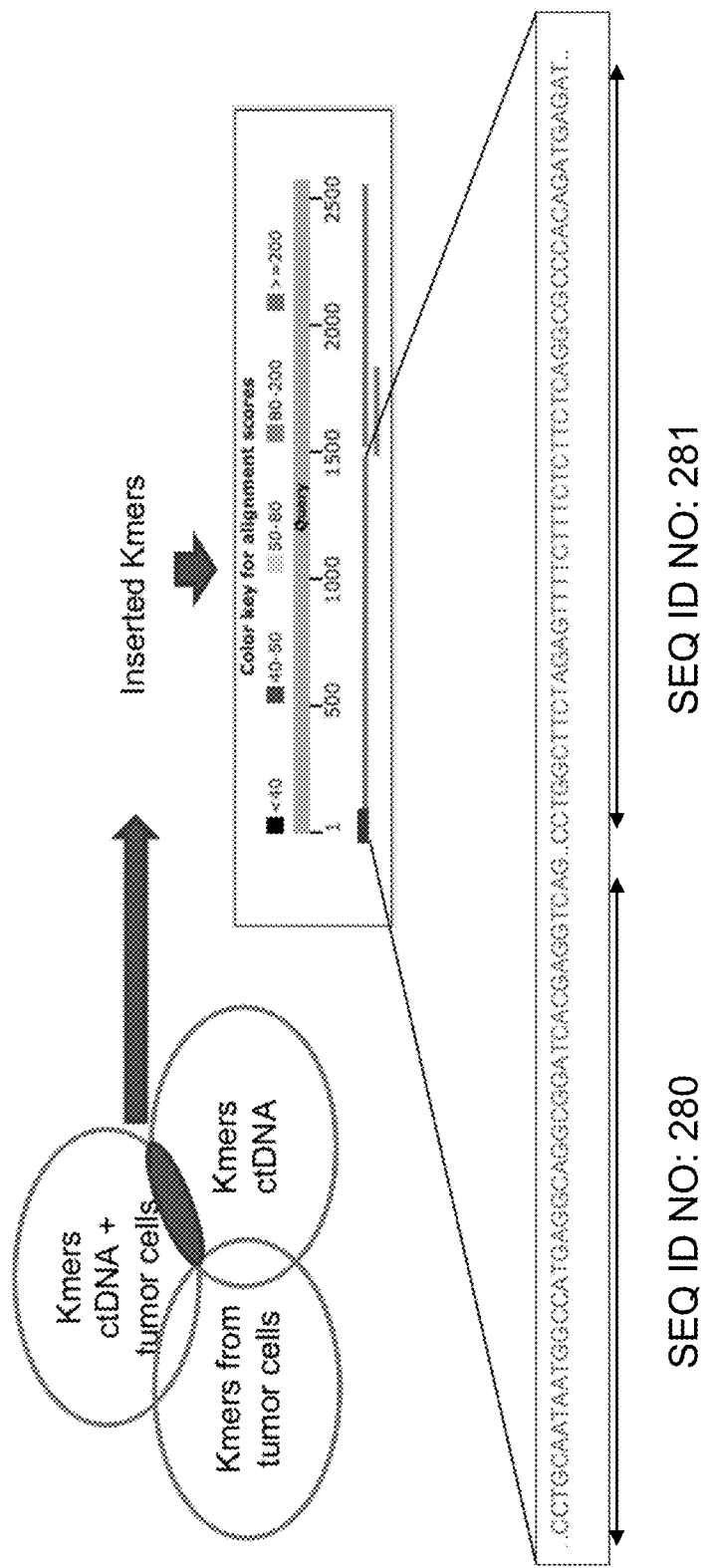
FIG. 19 schematically illustrates the validation of chromosomal integration by, e.g., demonstrating sequence alignment matches of ctDNAs integrated into tumor chromosomes and those from ctDNA alone.

For example, FIG. 18 shows that MM ctDNA integrated into chromosomal DNA of MM cells (MM ctDNA is shown as red dots). Chromosomal integration of MM ctDNA was validated using sequencing in this study. FIG. 19 schematically illustrates the validation of chromosomal integration by, e.g., demonstrating sequence alignment matches of ctDNAs integrated into tumor chromosomes and those from ctDNA alone.

Example 7: The 5' and 3' Ends of ctDNA Frequently Contain Transposable Elements, and a Region from Such Transposable Elements (ZCSs) Specifically Targets One or More Cell Populations This example shows that the 5' and 3' ends of ctDNA frequently contain transposable elements (TEs) by attaching an adapter (PACbio) to both ends of the ctDNA to label the 5' and 3' ends, allowing for the recognition of the beginning and end of ctDNA upon sequencing. The ligation was then followed by regular Illumina-based library preparation methodologies.

Figure 8A:
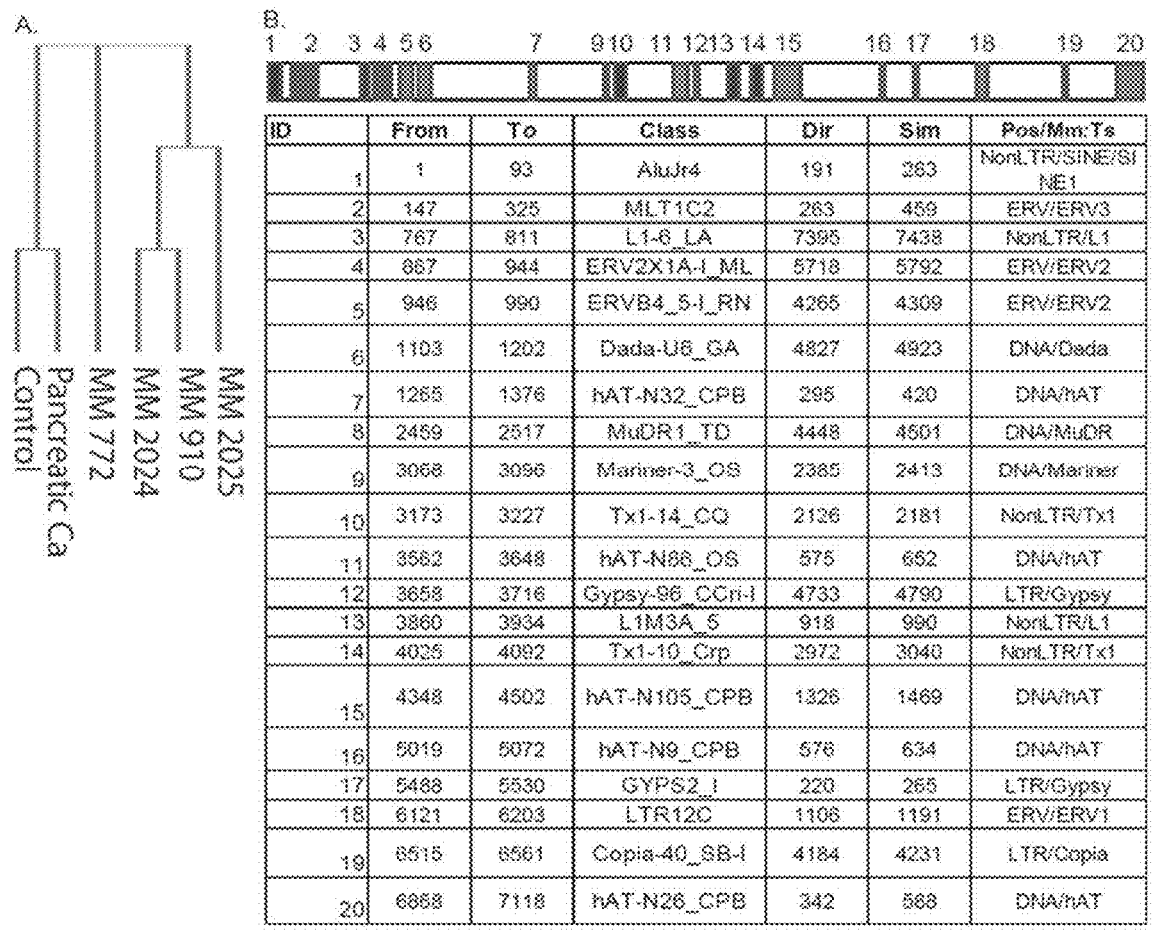
FIG. 8A shows a dendogram of the identified contig sequences from multiple myeloma, pancreatic cancer, and control cell lines. The index contig shows localization, type and presence of Zip Code Sequences.

A PACbio barcode was ligated to the 5' and 3' ends of ctDNA obtained from 4 patients with MM (MM 2025, MM 910, MM 2024, and MM 772), 1 patient with pancreatic cancer, and a control (healthy volunteer). PACbio-labelled ctDNA underwent standard library preparation using an Illumina library prep kit (e.g., Illumina TruSeq Stranded DNA Library Prep kit). Sequences of interest underwent identification by searching for the presence of the PACbio barcode. Once sequences were identified and sorted out, de novo assembly was performed. Subsequently, the contiguous (i.e., contig) sequences were compared between samples, and a group of contigs was identified that were common across all MM samples with more than 99% sequence similarity. FIGS. 8A-8B show results of a clustering analysis using consensus sequences derived from variants called on the contigs of each sample. MM samples clustered together compared to control or pancreatic cancer, suggesting that the structure of MM contigs are very similar among each other and only present in MM cells. By performing circulating DNA extraction and multiple methods of amplification, it was also shown that in diseases like myeloma, circulating tumor DNA (ctDNA) reflects 97% of the tumor genome.

The Gin repbase software to analyze and identify the presence, location and type of transposons of all contigs. The results of the analysis demonstrated that all contigs have a high content of transposons. Interestingly, the majority of the contigs have transposons at the extreme ends of the sequence as shown in an index contig displaying the location and type of transposon (FIG. 6).

Example 8: ctDNA Sequences Specifically Target Tumor Cells and Avoid Uptake in Off-Target Tissues in Xenograft Models This example demonstrates that cancer-derived, ZCS-comprising human cell-targeting nucleic acid sequences specifically target tumor cells of the same origin in-vivo while showing very low to no uptake in off-target tissue.

In order to evaluate the ability of ctDNA to recognize a specific target tissue in vivo, a xenograft mouse model using the human derived pancreatic cell line MT5 was developed. Specifically, one million cells were injected bilaterally into the dorsum of immune-deficient BNX mice. After reaching a tumor volume of approximately 0.5 cm, mice were assigned to specific experimental arms. Mice of cohorts #1 and #2 were injected with rhodamine-labelled pancreatic cancer patient-derived ctDNA via the tail vein. Tumors were harvested 24 and 48 hours post injection, respectively. Cohort #3 underwent direct injection of rhodamine-ctDNA construct into the tumor 24 hours prior to tumor harvesting. Cohort #4 was a negative control and underwent PBS tail injection 24 hours prior tumor harvesting. At harvest, tumors and selected organs (liver, lung and spleen) were isolated and underwent frozen sectioning. Tissue slides were fixed with paraformaldehyde (4% v/v) and were subsequently stained with 4',6-diamidino-2-phenylindole (DAPI)

Figure 9:
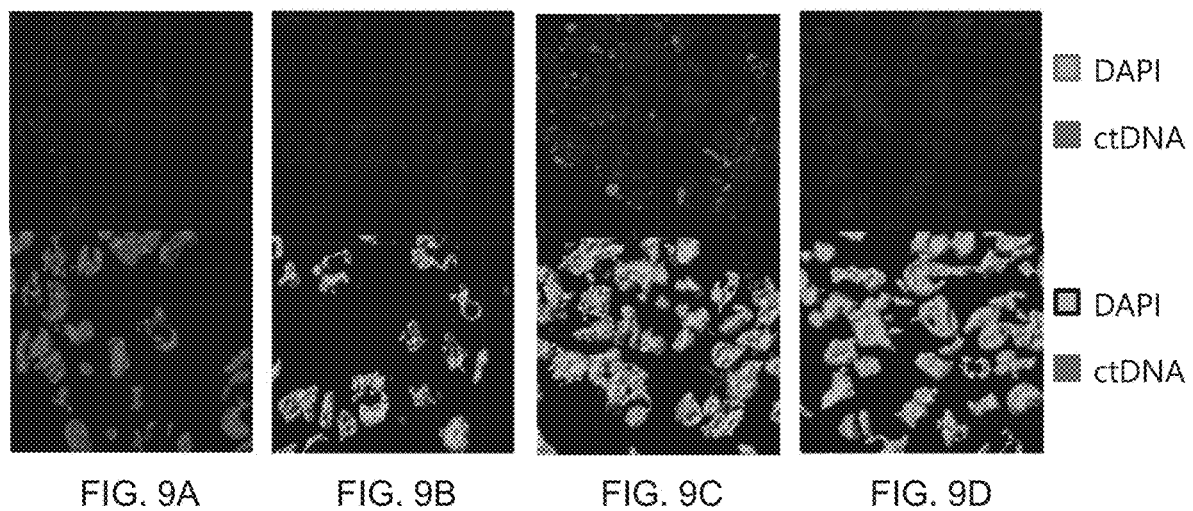
FIG. 9 shows confocal microscopy images of rhodamine-labeled ctDNA constructs present in the tumor, including localization of the ctDNA in the nuclei, after systemic or local administration.

Confocal microscopy demonstrated that various levels of rhodamine-labeled ctDNA constructs were present in the tumor but not in other tissue. When injected 48 hours prior to harvest (FIG. 9C, FIG. 10C), tumor cells showed much higher concentrations of labeled ctDNA compared to tumor cells that were harvested 24 hours after administration, both via tail vein injection (FIG. 9B, FIG. 10B) and direct tumor injection (FIG. 9A) compared to control mice that received PBS only (FIG. 9D, FIG. 10A). Similarly, nuclear localization of rhodamine-ctDNA constructs was significantly higher in tumors harvested 48 hours post injection (FIG. 9C) compared to tumors that were harvested 24 hours after administration (FIG. 9A-FIG. 9B). Evaluation of rhodamine-ctDNA uptake in potential clearance organs such as liver, lung, or spleen showed no detectable uptake of rhodamine-ctDNA construct in those organs.

Thus, these results demonstrate the high specificity of ctDNA for tumor tissue of the same origin (pancreatic cancer in this case). The in vivo model shows that ctDNA obtained from pancreatic cancer patients exclusively targets pancreatic cancer cells without showing any uptake in other organs, including the liver or the reticuloendothelial system. Hence, the Zip Code Sequences of ctDNA may enable highly specific targeting of tissue of the same origin.

Example 9: The Use of ZIP Code Gene Delivery for Treating and Monitoring Multiple Diseases This example demonstrates how the use of the ZIP code gene delivery for treating and monitoring multiple diseases can offer significant advantages over existing technologies employing viral vector delivery systems.

Figure 11:
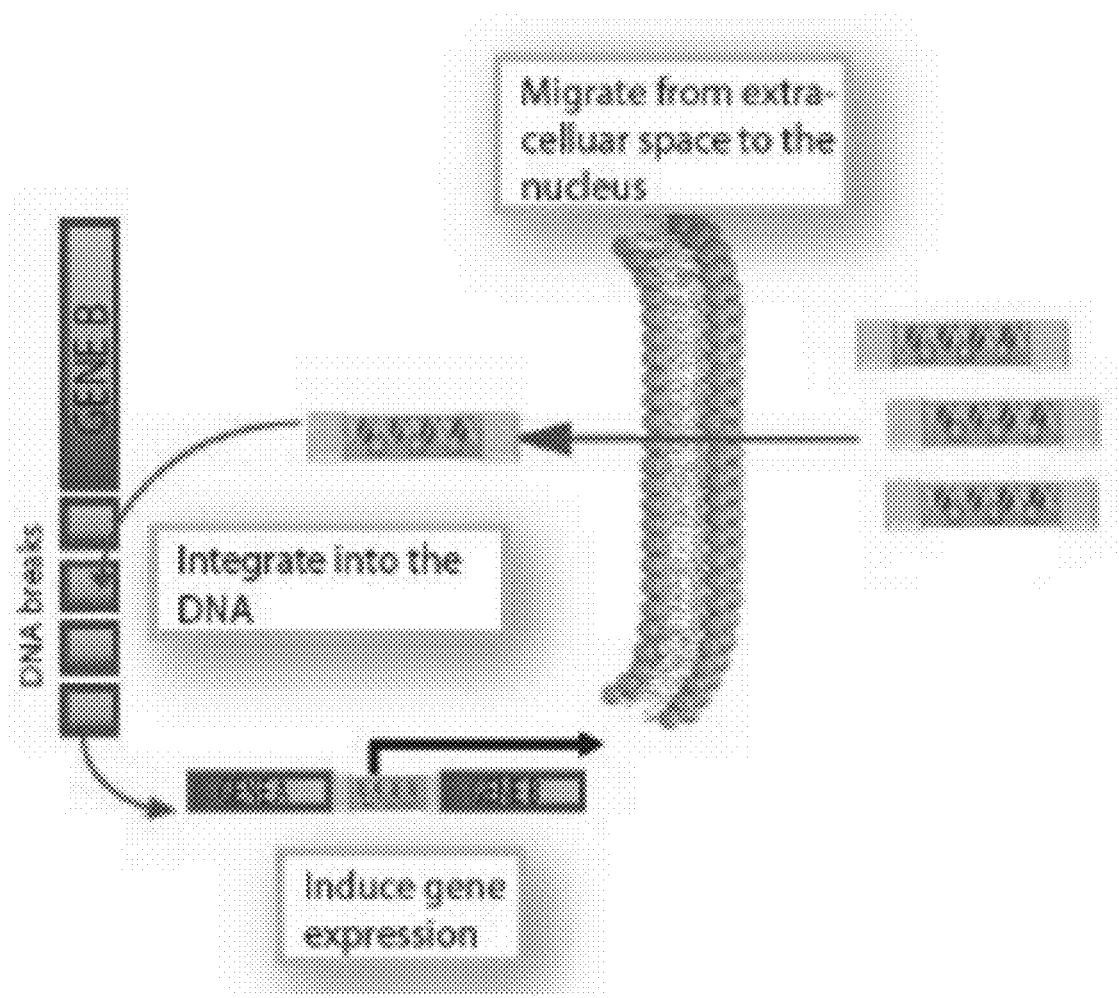
FIG. 11 is a figure illustrating a mechanism for the endogenous integration of constructs comprising tissue specific zip codes.

It has previously been shown that circulating DNA (cDNA) enables the exchange of genetic information between cells. As shown in previous examples above, it was demonstrated that cDNA is further capable of entering the nucleus and integrate into the chromosomes of target cells (see, e.g., FIG. 11). This may occur without the need for lipid membranes encasement (e.g., exosomes, microvesicles). Moreover, it was shown above that cDNA cell targeting is selective for cells of the same origin. For example, it was shown that cDNA that originated in the lung only penetrates the nuclear membrane of cells from (or are derived from) lung tissue but not the nuclear membrane of cells from other tissue types. Moreover, cDNA generates genomic instability upon entrance to the nucleus by causing double stranded DNA breaks, and thus facilitates its integration into the cell genome.

Considering the drawbacks of using conventional viral vector systems as gene delivery vehicles such as risks for off-target mutagenesis, the novel approaches of the present disclosure using the newly identified tissue/cell-specific recognition sequences (i.e., Zip Code Sequences) may offer significantly reduced off-target effects during tissue targeting and/or cargo delivery.

Example 10: The Use of Zip Code Sequences for Disease Diagnostic and Treatment Monitoring The cell and tissue specific nucleic acid sequences of the present disclosure (i.e., ZCSs) may be useful in the diagnosis and staging of disease and for monitoring response to therapeutic interventions. For example, ctDNA extracted from a subject having a tumor can serve as a biomarker for disease stage and severity.

Extracted ctDNA from a subject is analyzed for cell and tissue specific recognition signals and integration signals. The quantity of nucleic acid sequences comprising these recognition and integration signals detected per mL serum can be used to evaluate the stage of the disease. For example, a concentration of ctDNA-derived ZCSs can be associated with a metastatic disease stage.

Furthermore, the type of cell and tissue-specific recognition signals identified in a subject's blood as well as their concentration can provide information on tissue of origin of the primary tumor and possible site for metastasis or metastatic niche formation.

Upon administration, the uptake of the nucleic acid constructs as described herein in the cells of the target tissue is monitored via PCR of the subject's blood sample a reduction of circulating nucleic acid constructs is a measure for its uptake in the target tissue. Alternatively, and as described above, the use of radiolabeled nucleic acid constructs provides a non-invasive approach for in the in vivo tracking (e.g., uptake in the target tissue of interest) of the constructs following systemic administration.

Example 11: Cell-Specific Zip Code Sequences as a Therapeutic

This example demonstrates that the ZCSs of the present disclosure can be used for cell and/or tissue-specific delivery of therapeutic and/or diagnostic cargo (e.g., therapeutic proteins or polypeptides, small molecule therapeutics, radionuclides). Specifically, this example demonstrates cell-specific delivery and integration of a gene of interest that codes for a therapeutic protein.

Cell-specific recognition sequences and genome integration sequences are identified as described above in EXAMPLE 2. A gene of interest coding for a therapeutic protein (e.g., surface antigen CD19) can be flanked at the 3' and 5' ends by the integration signal sequence which is then flanked by the cell recognition sequence (see e.g., FIG. 12) to produce the therapeutic nucleic acid construct.

Cells of the same tissue type or origin as the ctDNA used for identifying the targeting and integration signals are incubated with the therapeutic nucleic acid construct. In the case of a CD19-coding transgene, cells are harvested and analyzed for CD19 surface expression using fluorescence-assisted cell sorting (FACS). Cells are also stained with anti-CD19 antibodies and the expression density per cell is determined, which, indirectly serves as a measure for integration efficiency of the nucleic acid construct.

Based on the performance of the nucleic acid construct as shown in vitro results, several parameters of the nucleic acid delivery system may be optimized by performing several rounds of in vitro experiments with varying recognition and integration sequences and, optionally, the use of guide sequences for enhanced cell-specific targeting and protein expression.

Example 12: Tumor Cell-Specific Zip Code Sequences Deliver Suicide Gene to Tumor and Induce Tumor Regression This example demonstrates that tumor-specific ZCSs of the present disclosure almost exclusively target and accumulate in tumor cells. Moreover, such tumor-specific ZCSs deliver suicide genes to the tumor and induce a significant reduction in tumor size. This example demonstrates in vivo that multiple myeloma (MM) ZIP-code sequences deliver suicide genes to tumor cells and induce tumor regression in a Multiple Myeloma xenograft model.

In this example, a herpes simplex virus-thymidine kinase (e.g., HSV-TK) was used as a suicide gene for cancer therapy. The human herpes simplex virus thymidine kinase type 1 gene (e.g., HSVtk) was used as a conditional lethal marker in the mammalian tumor cells. Upon transcription and translation into enzyme thymidine kinase-1, this enzyme can convert nucleoside analogues (e.g., ganciclovir, gemcitabine, etc.) into toxic DNA replication inhibitors. Thus, in the herein presented study, transfer of the herpes simplex virus thymidine kinase (HSV-TK) gene into cancer cells of tumor-bearing mice using the herein disclosed tumor-specific ZCSs was followed by treatment with ganciclovir (GCV).

Tumor Xenografts Model

Tumor were induced by injecting approximately five million cells of a human-derived Multiple Myeloma cell line (e.g., MM1s) into the dorsum of two BNX mice. After reaching a tumor volume of 2 cm, mice were injected with 2 µg of the MM zip-code sequence (SEQ ID NO: 282) ligated to a CMV-HSV-TK containing nucleic acid fragment. At 48 hours post injection, both mice were treated daily intraperitoneally with Ganciclovir (100 µg/kg). Tumor measurements were performed on a daily basis using electronic calipers. Tumor volume was calculated based on the measures of the longest and the shortest axis as well as the width of the tumor (see, e.g., FIG. 13).

Results

Tumor measurements demonstrated a constant reduction in tumor size in both animals. Mouse #1 died after 4 days of treatment due to unknown causes. FIG. 13A and FIG. 13B display the change in tumor volume observed in mouse #2 treated with HSV-TK gene delivery following 5 days of treatment with Ganciclovir. FIG. 13C and TABLE 1 below show the measured changes in tumor volume in both animals that received the gene therapy in combination with being treated with Ganciclovir.

TABLE 1

Measurements of Tumor Volume in Therapeutic Gene Delivery Experiment

| Mouse #1 | | Mouse #2 | |
|---|---|---|---|
| Days of treatment | Tumor volume [mm$^3$] | Days of treatment | Tumor volume [mm$^3$] |
| 1 | 17512.2 | 1 | 17608.8 |
| 2 | 15005.76 | 2 | 15616.26 |
| 3 | 12429.2 | 3 | 14007 |
| 4 | 11226.6 | 4 | 10692 |
| 5 | 9276.9 | 5 | n/a |

These results clearly validated the specificity of the Zip Code sequences provided in the present disclosure. MM-targeting Zip-Code sequences targeted MM tumors and delivered a functional transgene in an in-vivo model. Combination therapy with subsequently administered nucleoside analogue Ganciclovir clearly demonstrated a significant reduction in tumor size, indicating that the ZIP Code sequence delivered the suicide gene to tumor cells.

Example 13: Multiple Myeloma (MM)-Specific Zip Code Sequences are Highly Specific for MM Tumor Cells This example demonstrates that Multiple Myeloma (MM)-specific ZCSs of the present disclosure almost exclusively target and accumulate in tumor cells compared to other tissues of tumor-bearing mice.

Tumor xenografts were induced and the tumor-bearing mice treated using a gene therapy-nucleoside analogue combination as described above in EXAMPLE 12.

Animals were euthanized and organs including tumor, lung, and others were obtained. Tissue samples from each organ were prepared for PCR analysis to evaluate the levels of expressed herpes simplex virus-thymidine kinase-1 (HSV-TK-1) in each tissue.

Figure 14A:
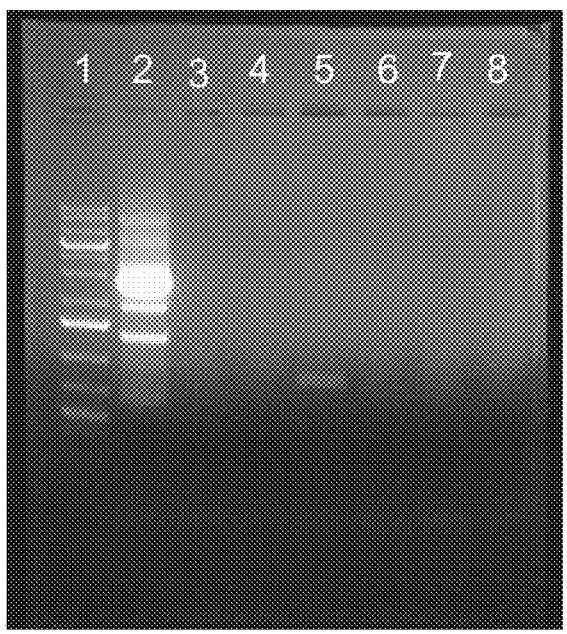
FIG. 14A and FIG. 14B show PCR results of various tissues from mouse #2 after receiving gene therapy with MM ZIP code-HSV-TK and, 48 later, 5 days of treatment with Ganciclovir (100 μg/kg). The PCR results clearly show the band corresponding to herpes simplex virus-thymidine kinase-1 only in tumor cells and tumor tissues, and not in any of the other organs analyzed in this study, demonstrating the high cellular and tissue specificity of the Zip Code Sequence and related constructs disclosed herein. The numbers indicate: (1) molecular weight latter; (2) tumor; (3) lung, (4) spleen, (5) liver, (6) pancreas, (7) brain and (8) kidney.
Figure 14B:
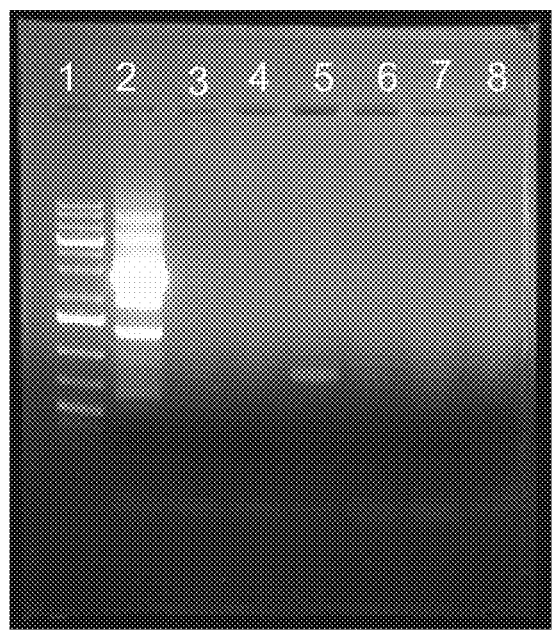

FIG. 14A and FIG. 14B show PCR results of various tissues from mouse #2 after receiving gene therapy with MM ZIP code-HSV-TK and, 48 later, 5 days of treatment with Ganciclovir (100 µg/kg). The PCR results clearly show the band corresponding to herpes simplex virus-thymidine kinase-1 only in tumor cells and tumor tissues, and not in any of the other organs analyzed in this study, demonstrating the high cellular and tissue specificity of the Zip Code Sequence and related constructs disclosed herein. The numbers indicate: (1) molecular weight latter; (2) tumor; (3) lung, (4) spleen, (5) liver, (6) pancreas, (7) brain and (8) kidney.

These data demonstrate the high cell—and tissue specificity of the zip-code sequences of the present disclosure. The observed high specificity for their respective cell and/or tissue of origin may allow for improved gene delivery and gene therapy and diagnostics methodologies using the herein described zip-code nucleic acid sequences.

Example 14: Multiple Myeloma (MM)-Specific Zip Code Sequences Deliver Transgenes into MM Cells and Allow for Subsequent Transgene Expression This example demonstrates that the herein described Multiple Myeloma (MM)-specific Zip Code Sequences deliver transgenes into MM cells and allow for subsequent transgene expression.

FIG. 20 schematically illustrates a MM-specific Zip Code sequence construct of the present disclosure. Such a construct comprised two Zip Code sequences (e.g., about 300 bp in length) that flank, on either site, a construct comprising a translation element (e.g., IRES), a GFP-coding sequence, a promotor, a luciferase-coding sequence, and one or more rhodamine dye molecules that was attached to the luciferase- and/or IRES-coding portion of the construct, and was used for tracking movement of the construct (or fragments thereof) in vitro and/or in vivo.

The MM-specific Zip Code construct described in FIG. 20 was evaluated for its ability to deliver the transgene into MM tumor cells and subsequent expression of the transgene.

Figure 21A:
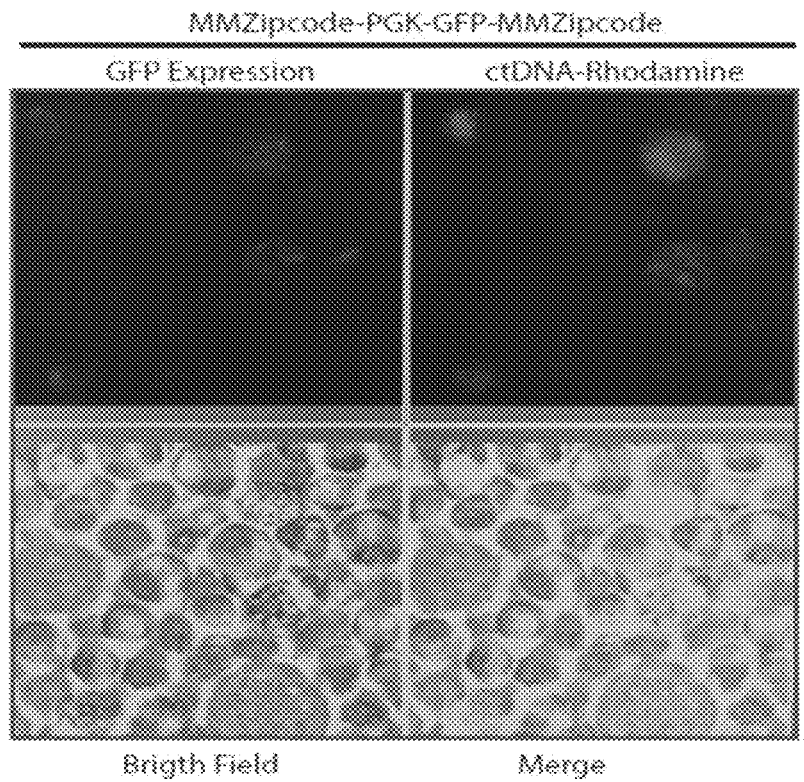
FIG. 21A shows that GFP (green, top left) expression and rhodamine detection of the ZCS construct (MMZipcode-PGK-GFP-MMZipcode) corresponded in their localization within MM cells, indicating efficient delivery of the ZCS construct into MM cells, delivery of the transgene, and expression of said transgene.

FIG. 21A shows that GFP (green, top left) expression and rhodamine detection of the ZCS construct (MMZipcode-PGK-GFP-MMZipcode) corresponded in their localization within MM cells, indicating efficient delivery of the ZCS construct into MM cells, delivery of the transgene, and expression of said transgene. This demonstrates that the ZCS constructs of the present disclosure can be used for efficient gene delivery and subsequent expression of said transgene.

Figure 21B:
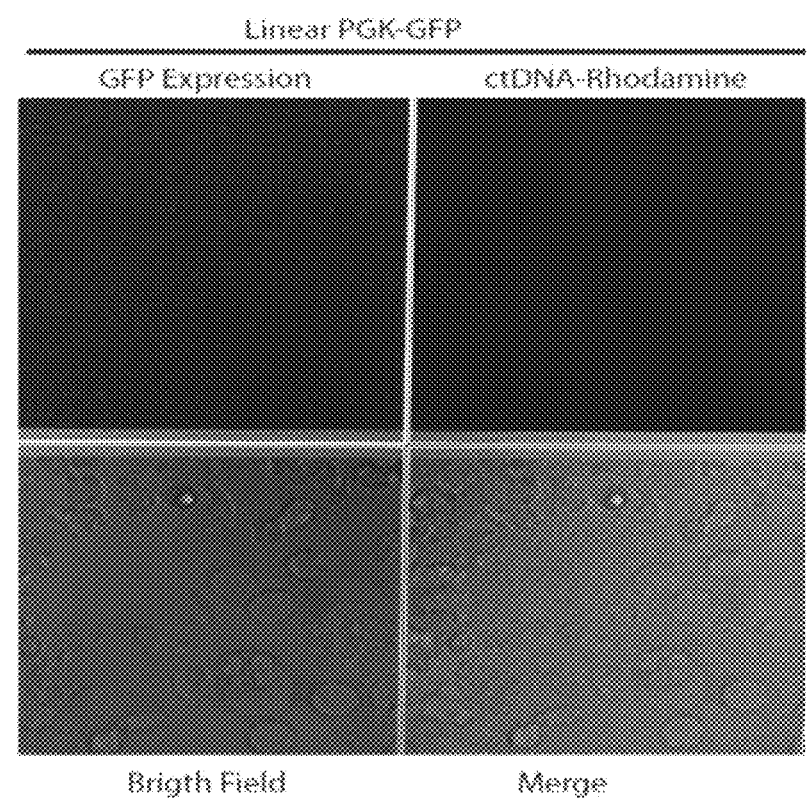
FIG. 21B shows that use of the linear PGK-GFP construct alone does not show any cell-specific location of signal, confirming that the Zip Code sequences are responsible for the MM-cell specific uptake of the MMZipcode-PGK-GFP-MMZipcode constructs.

The negative control construct comprising a linear PGK-GFP construct without the Zip Code sequences did not show any transgene expression. FIG. 21B shows that use of the linear PGK-GFP construct alone does not show any cell-specific location of signal, confirming that the Zip Code sequences are responsible for the MM-cell specific uptake of the MMZipcode-PGK-GFP-MMZipcode constructs.

Figure 22:
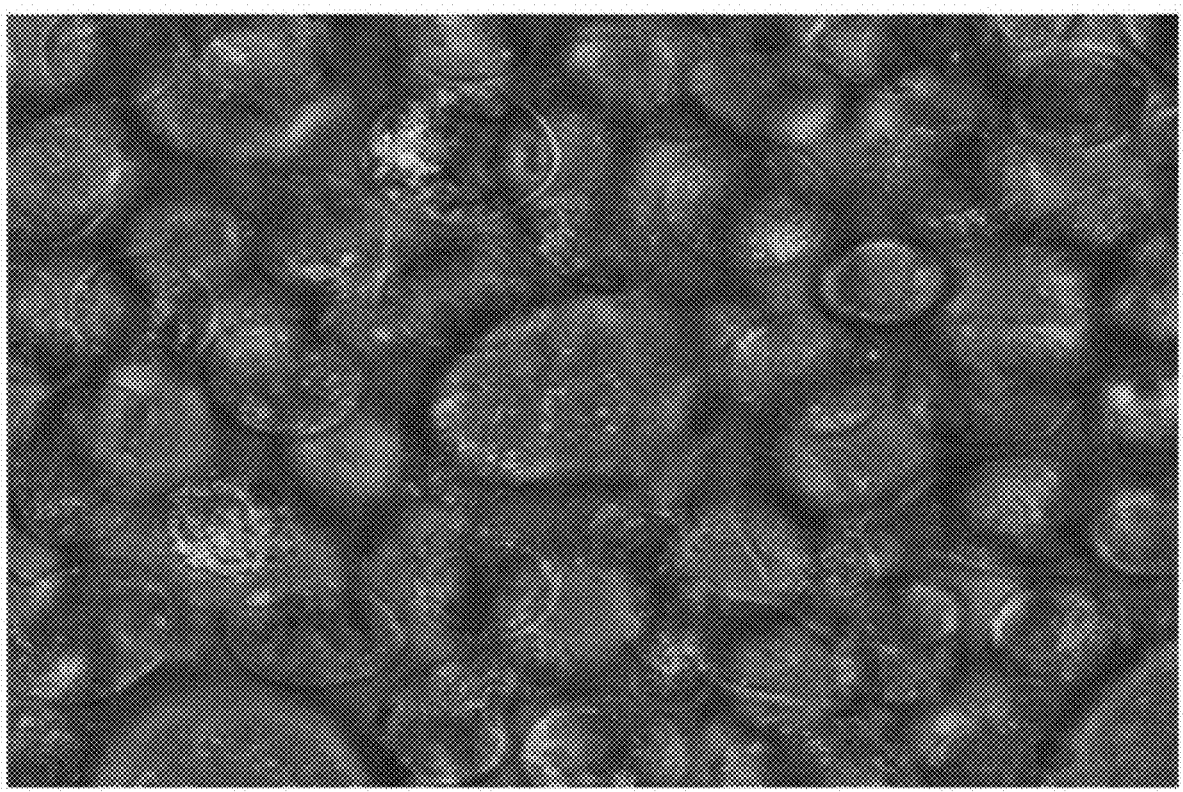
FIG. 22 shows a magnified image of cellular uptake of MMZipcode-phage-GFP-IRES-Luc constructs into MM cells. Image evaluation showed up to 100% gene delivery into MM cells using this construct, indicated by the production of GFP by up to every MM cell that was analyzed.

FIG. 22 shows a magnified image of cellular uptake of MMZipcode-phage-GFP-IRES-Luc constructs into MM cells. Image evaluation showed up to 100% gene delivery into MM cells using this construct, indicated by the production of GFP by up to every MM cell that was analyzed.

These results demonstrate that the herein described Zip Code sequences can be used as highly specific and highly efficient gene delivery constructs. These constructs not only localize in the target cell's nuclei but also allow efficient chromosomal integration of said transgene as well as its subsequent expression. Therefore, the herein described Zip Code sequences can be used as gene delivery constructs for various applications, e.g., as therapeutic and/or diagnostic constructs applicable to a variety of diseases. Importantly, such efficient and specific gene delivery can be achieved without the use of delivery vectors (e.g., viral vectors).

Example 15: Pancreatic Cancer (PC)-Derived Zip Code Sequences Target and Show Nuclear Localization in Pancreatic Cancer Cells In Vivo This example demonstrates that the herein disclosed PC-derived Zip Code Sequences target pancreatic tumor cells in vivo and show high nuclear localization.

Tumor were induced by injecting approximately five million cells of a human-derived pancreatic cancer cells into the dorsum of two BNX mice. After reaching a tumor volume of 2 cm, mice were injected with 2 µg of PC-derived Zip Code Sequence constructs.

Figures 23, 23A, 23B, 23C:
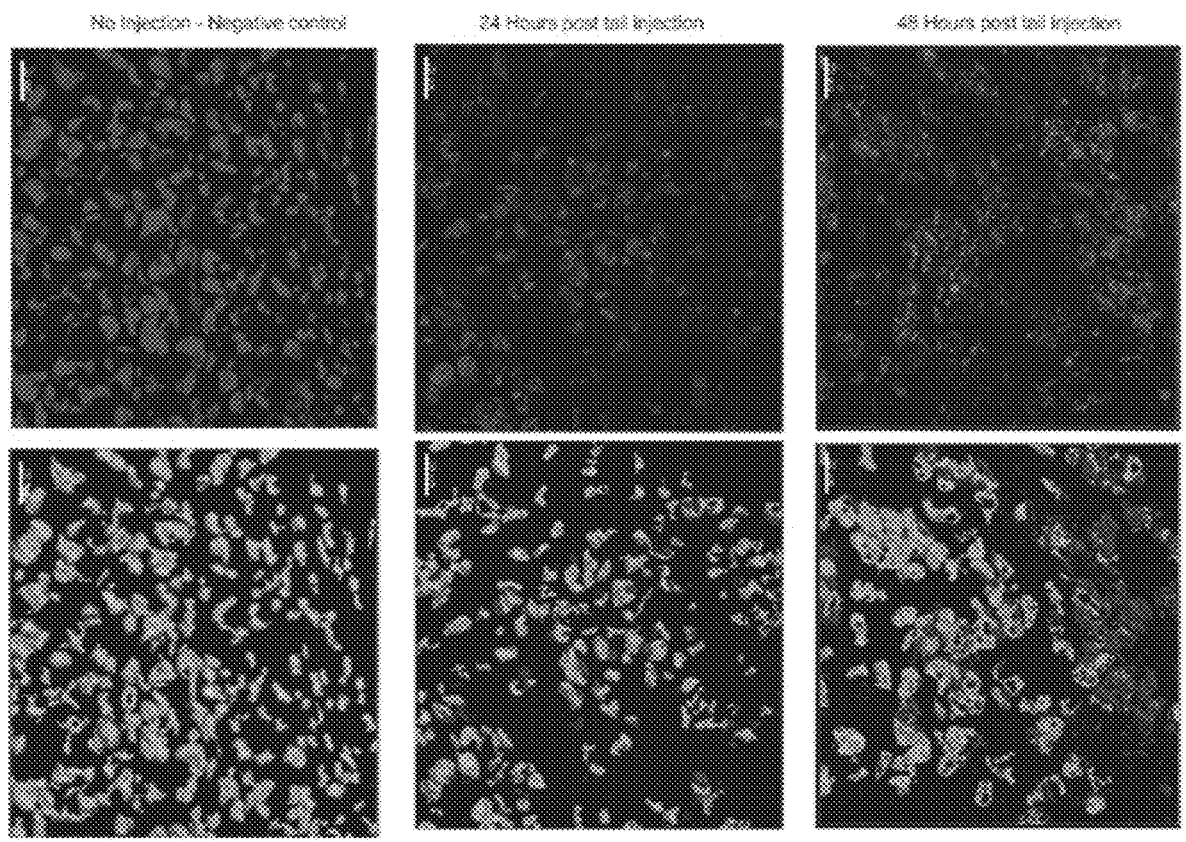
FIG. 23 shows results of an in vivo homing study of PC-derived ZCSs in a PC xenograft mouse model.
FIG. 23A shows the two images in the first column to the left that show the negative control without injection of any construct.
FIG. 23B shows the two images in the column in the middle that show accumulation of PC-derived ZCSs in PC cells 24 hours after administration (via the tail vein).
FIG. 23C shows the two images in the column to the right that show accumulation of PC-derived ZCSs in PC cells 48 hours after administration (via the tail vein). Tissue samples obtained from the liver and spleen from this animal showed no uptake of PC-derived ZCSs, confirming the cellular specificity of the ZCSs of the present disclosure.

FIG. 23 shows results of the in vivo homing study of PC-derived ZCSs in a PC xenograft mouse model. FIG. 23A shows the two images in the first column to the left that show the negative control without injection of any construct. FIG. 23B shows the two images in the column in the middle that show accumulation of PC-derived ZCSs in PC cells 24 hours after administration (via the tail vein). FIG. 23C shows the two images in the column to the right that show accumulation of PC-derived ZCSs in PC cells 48 hours after administration (via the tail vein). Tissue samples obtained from the liver and spleen from this animal showed no uptake of PC-derived ZCSs, confirming the cellular specificity of the ZCSs of the present disclosure.

Figure 24:
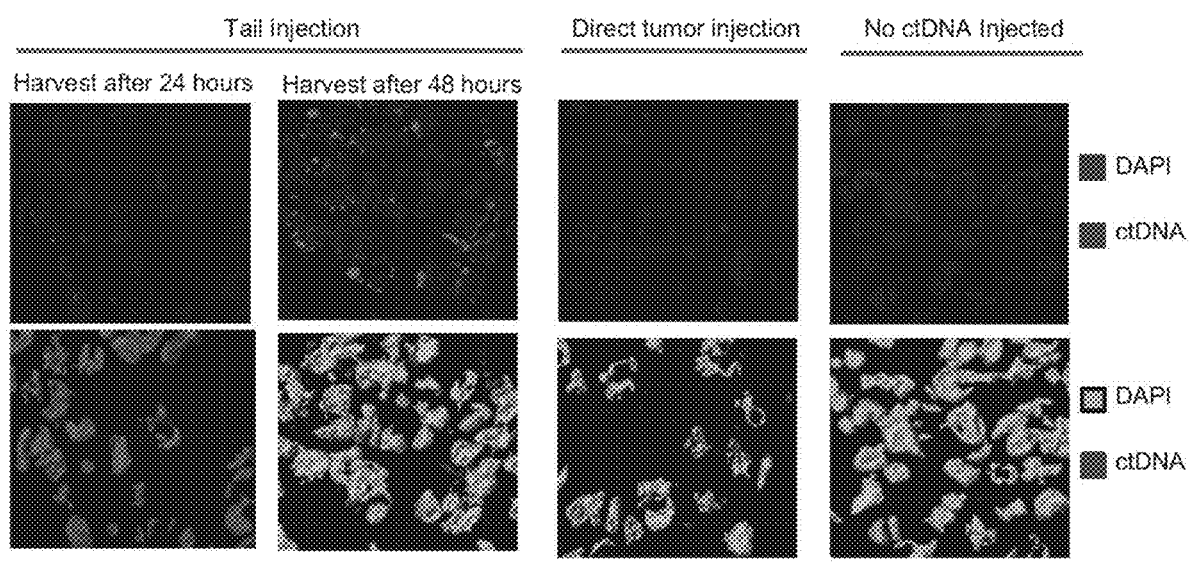
FIG. 24 shows results of a pancreatic cancer (PC) in vivo homing study of PC-derived cell-targeting nucleic acid sequences in a PC xenograft mouse model.

Moreover, it was shown that systemic administration, here shown by administration of the constructs via the tail vein results in high uptake and nuclear localization of these constructs in PC cells. FIG. 24 shows results of a pancreatic cancer (PC) in vivo homing study of PC-derived ZCSs in a PC xenograft mouse model. FIG. 24A shows data that demonstrate significant accumulation and update in PC cells 24, and particularly 48 hours post injection via the tail vein. FIG. 24B shows that uptake in tumor cells was significantly reduced when the PC-derived ZCSs were injected directly into the tumor, suggesting that ZCSs derived from ctDNA may provide improved cell- and/or tissue recognition and update when administered systemically. FIG. 24C shows the control experiment with now ctDNA injected.

This data demonstrates the high cell-, tissue-, and/or organ specificity of the constructs described herein. These results further show genomic delivery and integration of these constructs in vivo, indicating the therapeutic and/or diagnostic utility of these constructs.

Example 16: Zip Code Sequences can be Used as Cancer Vaccines for In Vivo Production of Immunogenic Peptides or Proteins This example demonstrates that the herein disclosed nucleic acid Zip Code Sequences can be used to deliver nucleic acid sequences into cancer cells, wherein the nucleic acid sequences encode one or more immunogenic peptides, capable of eliciting immune response against said cancer cell in a subject suffering from the cancer.

The nucleic acid Zip Code Sequence used to deliver immunogenic peptide encoding nucleic acid sequences are obtained as described in EXAMPLES 1 and 2. The Zip Code Sequences are used to generate a nucleic acid construct (e.g., a Zip Code construct) comprising a nucleic acid sequence encoding for one or more immunogenic peptides or proteins, flanked by one or more Zip Code Sequences that comprise one or more cell recognition and chromosomal integration signals.

The Zip Code construct is administered to a subject suffering or is suspected of suffering from a cancer. The Zip Code construct homes to cancer cells upon administration to the subject. The Zip Code construct is integrated into the genomes of the cancer cells, followed by expression of the immunogenic peptides or proteins by the cancer cells. The expression of the immunogenic molecules is tracked using constructs comprising a GFP encoding sequence. The immunogenic peptides or proteins produced by the cancer cells elicit an immune response in the subject. The cancer is significantly reduced in size, and eliminated (e.g., presence of cancer/cancer cells non-detectable) shortly thereafter (e.g., as determined by nuclear imaging and/or imaging using labeled Zip Code sequences.

This data shows that the herein described constructs can be used as cancer vaccines to prevent and/or treat cancerous diseases.

Example 17: Synthesis, Characterization, and Purification of Oligonucleotide Zip Code Sequences (Oligo-ZCSs), Nucleic Acid Constructs, and Delivery Systems This example demonstrates the synthesis, characterization, and purification of oligonucleotide Zip Code Sequences (oligo-ZCSs), nucleic acid constructs, and delivery systems described herein, e.g., those comprising or consisting of any one or more of any of the isolated consensus sequence with SEQ ID NOs: 1-202, and/or any of the self-integrating nucleic acid sequences with SEQ ID NOs: 203-277, or 282.

Generally, double-stranded nucleic acid sequences were either chemically or enzymatically synthesized by an outside vendor. Upon receipt, the nucleic acid molecules were purified, e.g., using desalting methods followed by analytical confirmation of sequence and structure.

Example 18: Prevention of Cancer and Cancer Relapse Using the Herein Described Nucleic Acid Zip Code Sequences This example demonstrates that the herein described nucleic acid constructs comprising one or more Zip Code Sequences can be used to prevent the formation of cancer and/or to prevent relapse of cancer following treatment.

This study demonstrates that Zip Code Sequences of the present disclosure (e.g., oligo-ZCSs) can be used to prevent cancer formation by binding and/or capturing tumor-associated nucleic acid molecules in the body (e.g., the circulatory system and/or other organs or tissues) of a subject. The subject is a rodent or a human.

To that end, a pancreatic cancer (PC)-specific ZCS molecule derived from ctDNA of a pancreatic cancer patient is administered (e.g., as a pharmaceutical composition) to a group of subjects at risk of developing a pancreatic cancer (e.g., after successful treatment and to prevent a relapse). The cohort of subjects receiving the (PC)-specific ZCSs shows a significantly lower rate (e.g., relapse rate) of developing PC.

Analyses of serum samples of these subjects show that the (PC)-specific ZCSs bind and capture circulating tumor-derived nucleic acid molecules in the subject, suggesting that disease prevention can be achieved via this therapeutic mechanism.

Thus, the herein described ZCSs can not only be used for the treatment of cancer but also for the prevention of cancer. Without being bound to any theory, it is assumed that the herein described ZCSs bind and capture circulating tumor DNA, thereby (i) preventing or reducing such ctDNA from reaching distant tissues and/or organs and inhibiting metastases formation; and (ii) inhibiting or reducing growth and proliferation of the primary tumor (e.g., by inhibiting or reducing cellular cross-talk, formation of tumor vasculature, etc.).

Example 19: General Experimental Methods

This example describes experimental methods used herein for the construction, analysis and evaluation of the target (e.g., cell-) specific nucleic acid molecules described herein.

Clinical Specimens and Sample Preparation

Retrospective plasma samples from 10 multiple myeloma (MM) and pancreatic cancer (PC) patients, four lung cancer, and four colon cancer patients were obtained from available stored samples in the tissue and acquisition bank at the Winship Cancer Institute. Ten patients with multiple myeloma were treated with bortezomib-containing regimens or pancreatic patients treated with gemcitabine, and samples used were selected according to their status of the disease (response or progressive disease). Response in MM was determined using International Uniform Response Criteria for Multiple Myeloma, and RECIST criteria were used in pancreatic cancer patients. Plasma was isolated using centrifugation methods. Blood was spun down at 1500 RPM for 10 minutes. The supernatant was collected for storage.

Cell Lines and Apoptosis Studies

Multiple myeloma (OPM, RPMI, JK6L, KMS11, KMS12, JJN3, and MM1S), pancreatic cancer (ASPC1, PANC1, MIA), colon cancer (HCT-116, RK8, and HCT) and lung cancer (A549) cell lines were grown in RPMI medium supplemented with 10% fetal bovine plasma, 1% L-glutamine, 1 mM sodium pyruvate, and 50 µg/ml penicillin-streptomycin.

For apoptosis studies, $10^4$ cells were treated with titrating doses of bortezomib (doses: 0.15, 0.25, 0.5, 0.750, 1, 1.5 and 2.5 mg/mL; obtained from Sigma Aldrich) or gemcitabine.

Twenty-four hours later, cells were stained with YO-PRO-1 and propidium iodide (Invitrogen). Live cells were measured using an ImageXpress 5000A Automated Acquisition and Analysis System (PI, Molecular Devices), quantitating YO-PRO-1, and propidium iodide-negative cells.

ctDNA Extraction and Immunofluorescent Labeling

Circulating tumor DNA was obtained from plasma using in-house developed ctDNA isolation and amplification kits. DNA was extracted following the manufacturer's protocol, except for amplification steps. Fluorescent labeling of ctDNA was performed using Label IT® Nucleic Acid Labeling, Cx-rhodamine, or CY5.

Immunofluorescence

About $10^6$ cells in 1 ml of RPMI medium with 10% FBS were incubated with Rhodamine- or CY5-labelled DNA at the different time points described herein. For live cell imaging, the cellular membrane was labeled following the cellLight Plasma Membrane-GFP, Bacman 2.0 protocol (TermoFisher Cat #10607). Pictures displayed are representative images from triplicated experiments.

Chromosome Spreads and ctDNA Banding Identification

Rhodamine-labeled ctDNA from 3 different patients with MM, PC, colon cancer (CC), and lung cancer were added to culture media of MM, PC, CC and lung cancer (LC). About $10^6$ cells in 1.5 mL of culture media were co-cultured with 100 ng/mL of rhodamine-ctDNA construct. At 24 hours of culturing, cells were transferred to 15 ml tube and incubated in 10 mL media with 15 µL Colcemid (101 g/mL) at 37° C. for 20 minutes before harvesting. After centrifugation and media removal, cells were resuspended in prewarmed 10 mL 0.075 M KCl and incubated at 37° C. for 20 minutes. Fixative (2 mL, 3:1 methanol:acetic acid) was added and incubated for 10 minutes before subsequent centrifugation and aspiration. Samples were then resuspended in 10 mL fixative and incubated at room temperature for 10 minutes, followed by two additional washes with a fixative. Slides were prepared in Thermotron where temperature and humidity are controlled for optimum metaphase spreading. Three 10 µl drops of DAPI antifade were added to each slide and cover slipped. Fixed cells were applied to slides using serial micropipetting, 3 µL at a time until at least 25 cells were visible per field at 20× magnification. After drying at room temperature for 1 hour, nuclei were stained with 4',6-diamidino-2-phenylindole (DAPI). Ten metaphase nuclei were counted per experiment with touching and overlapping cells excluded. The number of chromosomes with rhodamine-bands incorporated were counted.

Figure 32:
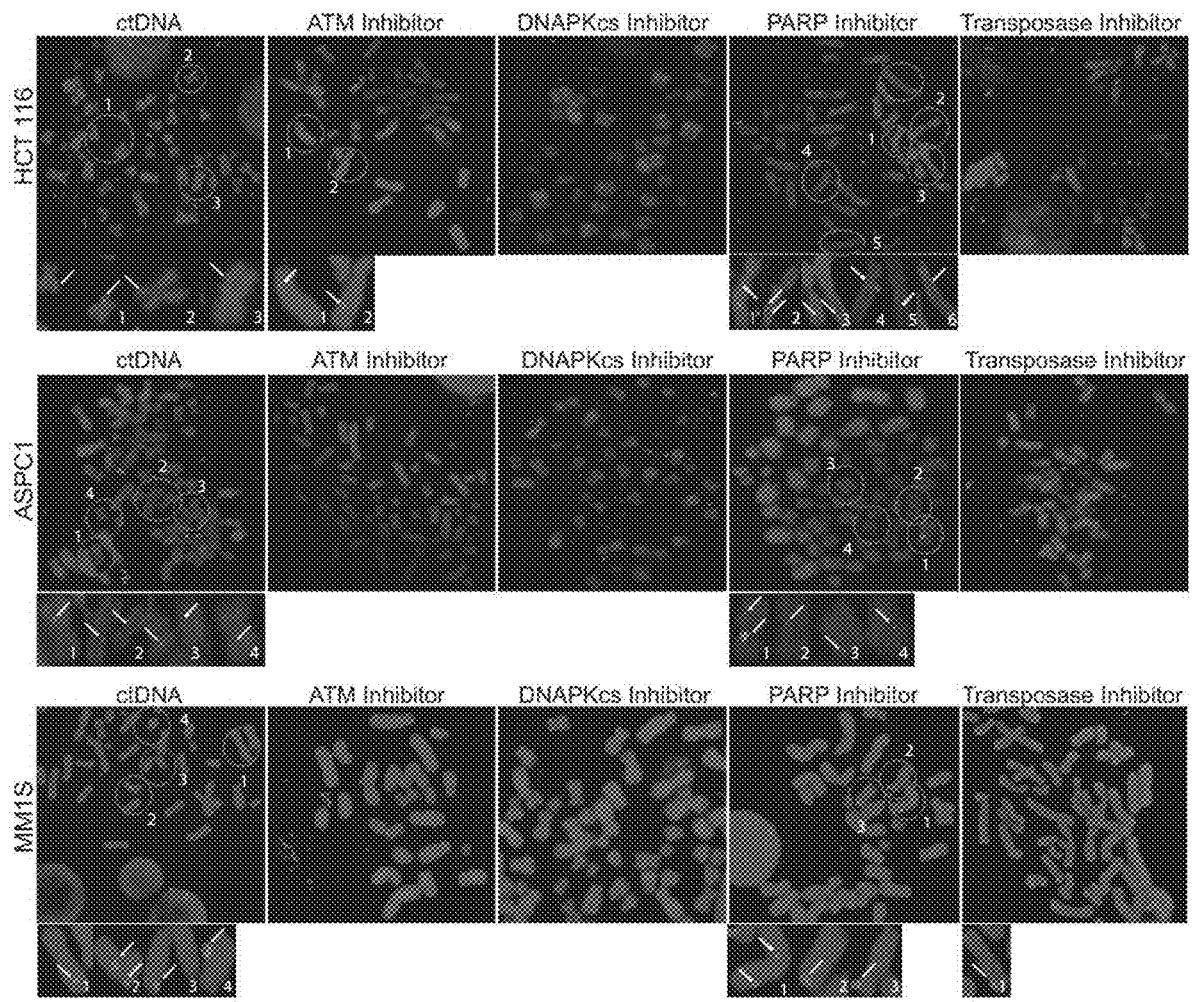
FIG. 32 shows metaphase index images of various cancer cell lines (MM1s, ASPC1 and HT116) treated with ATM, DNAPKcs, PARP and transposase inhibitors.

Assessment of ctDNA Integration with Non-Homologous End Joining Repair, the Alternative Pathway, and Transposase Inhibitors About $10^6$ MM1s, PANC1 and HCT-116 cells were treated for 2 hours with inhibitors of the non-homologous end join (NHEJ) repair system such as KU-55933 (ATM inhibitor, 10 µM) and DNA-PKCS inhibitor I, (30 µM), alternative repair pathway such as a poly ADP ribose polymerase inhibitor NU1025 (PARP, 200 µM) and an integrase/transposase inhibitor (raltegravir, 100 nM). After treatment with inhibitors, rhodamine-labeled ctDNA construct was added to the culture media for 24 hours. Cells were then arrested, and chromosome spreads were obtained as noted above. Integration site counts per cell were obtained after counting a minimum of 20 metaphases (FIG. 32).

Xenograft Experiments

A xenograft model was developed using a human-derived pancreatic cell line (MT5), MM cell line (MM1S), and colon cancer (HCT-116). To that end, approximately one million tumor cells of the respective cell line were injected bilaterally in the dorsum of J:NU (007850) outbred nude mice. After reaching a tumor volume of about 0.5 cm, mice were assigned to the specific experimental groups. Three mice underwent tail injection with rhodamine-labeled ctDNA construct and tumors were harvested 24 and 48 hours post injection, respectively. A fourth mouse underwent tail injection of rhodamine only (not coupled to a target-specific ctDNA, i.e., ZCS), and a fifth mouse was injected with PBS (control). At harvest, tumors and organs (liver, lung, small and large bowel, pancreas and spleen) underwent frozen section dissection. Each slide was fixed with paraformaldehyde 4% and stained with 4',6-diamidino-2-phenylindole (DAPI) before mounting the coverslip.

Whole Genome Sequencing ctDNA was extracted from 5 multiple myeloma (MM) and 10 pancreatic cancer (PC) patients using methods, as described above in this example. DNA from CD138(+) cells was extracted using Blood & Cell Culture DNA Mini Kit (Qiagen, MD) and Pancreatic cancer primary tumor DNA was obtained from FFPE samples after reviewing of tumor slides and core extraction of tumor-containing regions. DNA on these samples was obtained was extracted using QIAamp DNA FFPE Tissue Kit (Qiagen, MD). After extraction, ctDNA was ligated to PACBIO adaptor (GCGCTCTGTGTGCT (SEQ ID NO: 279)) following ABM DNA Library Prep Kit for Illumina Sequencing (Applied Biological Materials Inc. Canada). Subsequently, PACBio labeled ctDNA underwent standard methods for library preparation and sequencing using Illumina protocols. Applied Biological Materials Inc performed library preparation and whole genome sequencing. Average target coverage was 50×. For analysis, all reads aligned to the human mitochondrial genome were removed. Whole genome sequencing raw data were processed using Spades software to perform the de novo assembly. This analysis resulted in a total of 17 million contigs. Assembled contigs were then clustered using CD-HIT at 99% identity per tumor type. The centroids of clusters that contain all MM samples but none of the PC samples, and vice versa, were selected. From those contigs, only those sequences were selected that contained a PacBio barcode in either the 3' or 5' end.

Identification of Transposable Elements (TEs)

Contig sequences (contigs) were analyzed, and TEs were identified and classified using CENSOR Gin and RepeatMasker methods, which allowed the determination of the locations of transposable like regions in the contigs.

Transposon Linearized Vector

Sequences to the transposon containing mutations shared by all MM samples ACCCGGCCTTGGACACGCCAT-TTTCAACTCCGTGGTGCGTTTTTTTTTTTTTTTTTT TTTTTTGTAATGGAGTTTTGCTCTTGTTGCCCAG-GATGGAGTGCAAGGGATCTTGG CTCAC- CACAGCCTCTGCCTCCTGGGTTCAAGTGAT-
TCTTCTGCCTCAGCCTCCCAA
GTAGCTGGGATTATAAGCACCCACCAC-
CACGCCCAGCTAATTTTGTATTTTTTAG
AAGAGATGGAGTTTCTCCAGTTGGCCAG-
GATGGTCTGTATATCCTGACCTCATGA TCTGCC-
CACCA (SEQ ID NO: 282) was generated by Integrated DNA Technologies, Inc (IDT). This oligo was produced in two blocks to allow overcoming the poly T segment. Also, an EcoRI complementary site was added at the end to facilitate ligation to CMV-green fluorescent protein (GFP) or -herpes simplex virus thymidine kinase (HSVTK) linearized vectors.

Example 20: Plasma from Multiple Myeloma (MM) and Pancreatic Cancer (PC) Patients Treated with Bortezomib or Gemcitabine Transfers Drug Sensitivity or Resistance to MM or PC Cell Lines This example demonstrates that plasma from multiple myeloma (MM) and pancreatic cancer (PC) patients treated with bortezomib or gemcitabine, respectively, can transfer drug sensitivity or drug resistance observed in those patients to MM or PC cell in vitro.

For this experiment, plasma obtained from MM or PC patients was extracted accordingly to their status of response to bortezomib or gemcitabine. Subsequently, MM sensitive cell lines (OPM1 and MM1s) to Bortezomib and PC sensitive cell lines to gemcitabine (MIA) were cultured for 24 hours with the plasma of patients that had shown resistance to the corresponding drugs. Subsequently, titrating doses of bortezomib or gemcitabine were added to culture media and cell survival was measured 24 hours later.

Figure 25A:
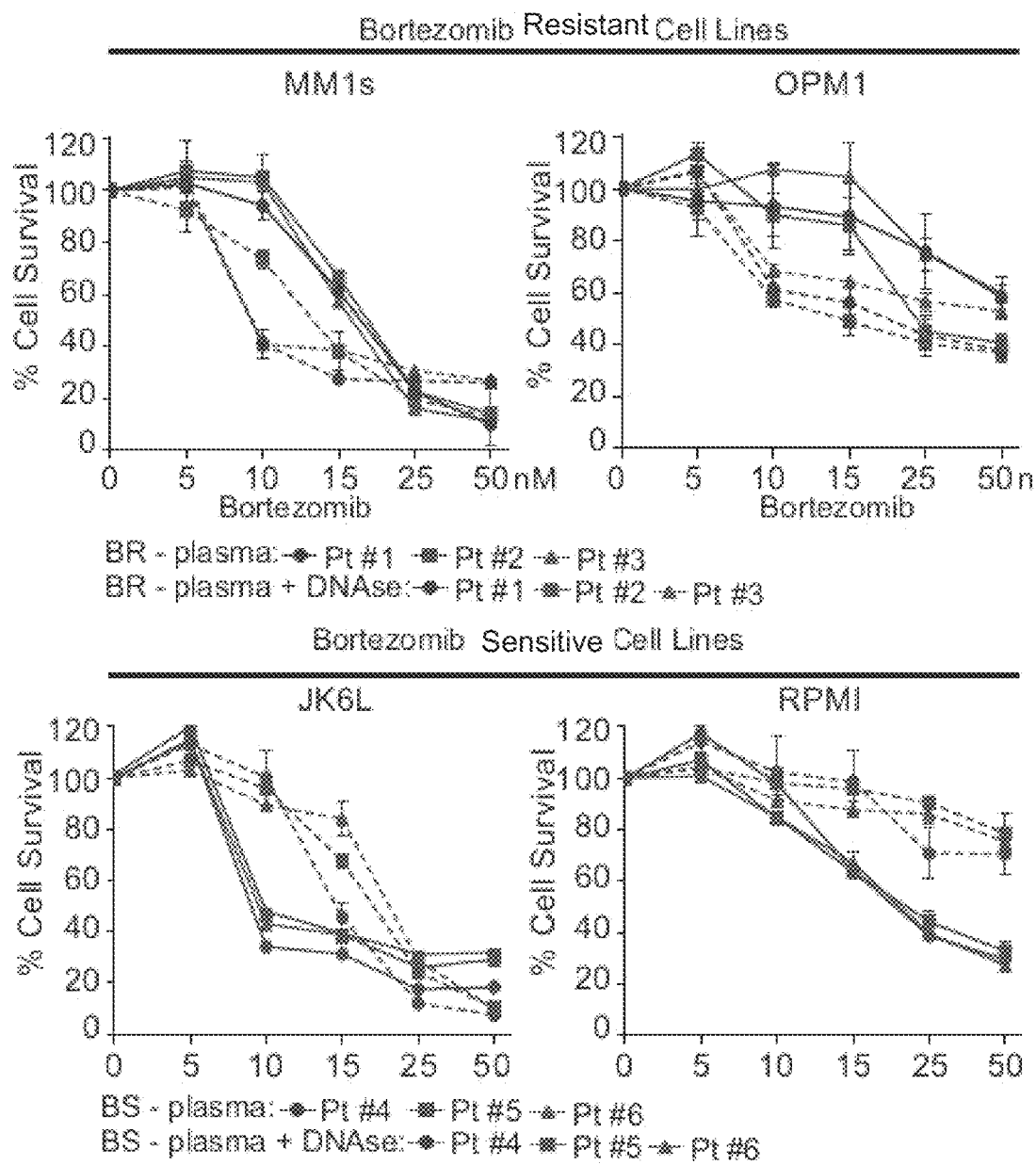
FIG. 25A shows cell viability measured in bortezomib-sensitive cells (OMP1 and MM1) treated with serum of a bortezomib-resistant patient and bortezomib-resistant cells (OMP1 and MM1) treated with serum of a bortezomib-sensitive patient. Cell viability was also measure in similar cells after serum was treated with DNase for 10 minutes.

These results demonstrate that adding the plasma of patients resistant to bortezomib led to an increased resistance of MM1s and OPM1 (FIG. 25A, top right and top left graphs). In contrast, when bortezomib-resistant MM cell lines (RPMI, JK6L) were cultured with the plasma of a patient that responded to bortezomib, cells restored their sensitivity to bortezomib significantly (FIG. 25A, bottom right and bottom left graphs). These observations were confirmed when the pancreatic cells (PANC1 and MIA) were co-cultured with the plasma of gemcitabine sensitive and resistant patients.

Figure 25B:
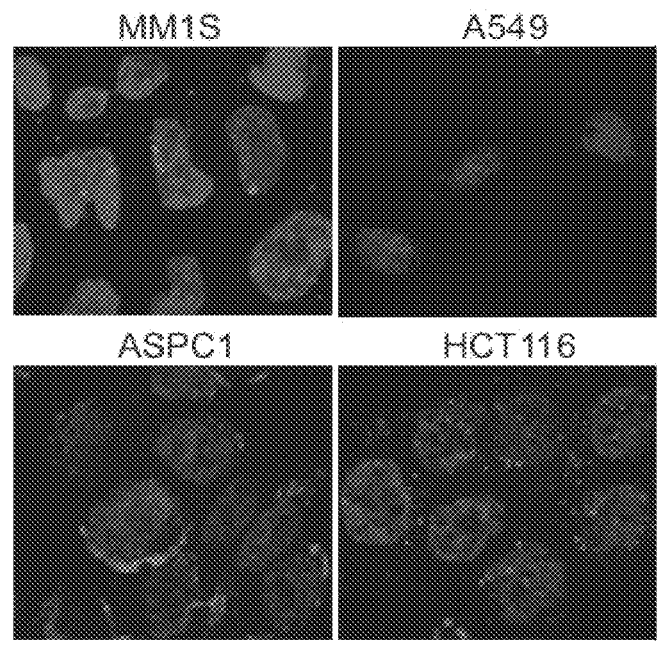
FIG. 25B shows index pictures displaying the nuclear localization of rhodamine labelled ctDNA (red) in MM and lung, pancreas and colon cancer cell lines.
Figure 25C:
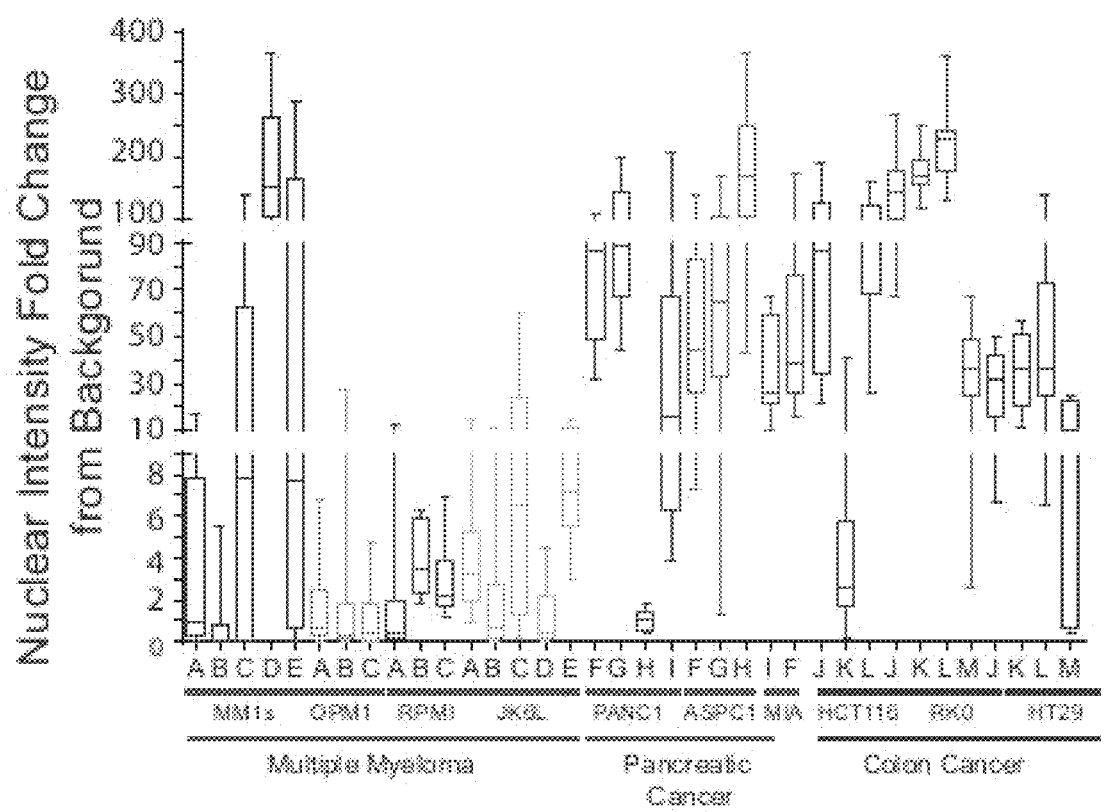
FIG. 25C shows the fold change of nuclear density measurements of multiple cell lines and patients derived ctDNA compared to baseline ctDNA alone density. The data of FIG. 25A-25C show that clinical sensitivity to bortezomib of patients can be transmitted to cell lines via ctDNA.
Figure 29A:
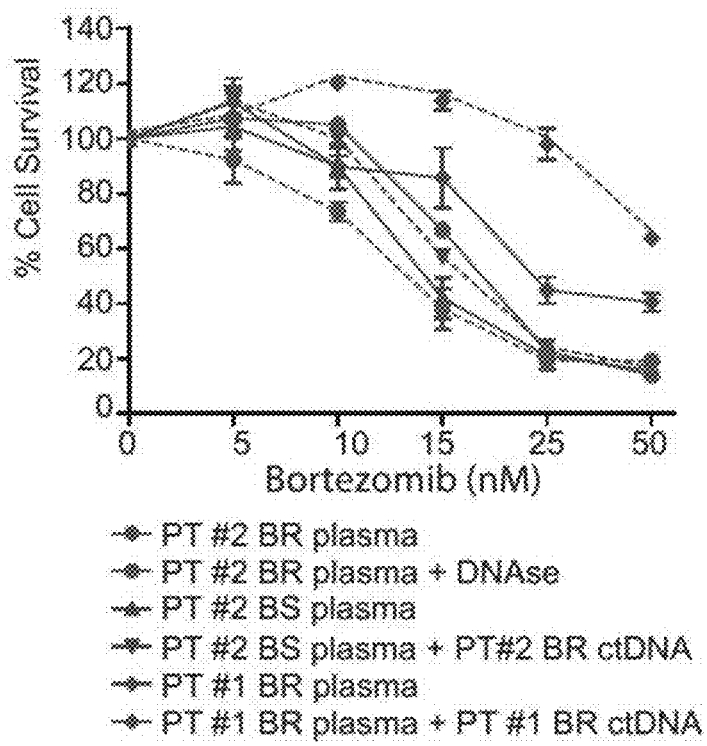
FIG. 29A shows cell viability measured in bortezomib-sensitive cell line MM1s treated with serum of a bortezomib-sensitive patient or same serum that had added to the culture media ctDNA from a bortezomib-resistant patient or when same serum was treated with DNAse. In addition, viability was measured in MM1s cells coculture with bortezomib-resistant serum alone or with ctDNA of a different bortezomib-resistant patient.

Moreover, in order to investigate whether ctDNA contributed to transmitting the response to treatment induced by the patient's plasma, the plasma of same patients above was treated with DNAase. The data show that this treatment restored the inherent sensitivity of the cells to the treatment (FIG. 29A). To further validate the contribution of ctDNA on transmitting drug response to cells, cell free ctDNA from bortezomib resistant cells were extracted and added to the media containing DNAase treated plasma of bortezomib-sensitive patients (FIG. 29A). Furthermore, when ctDNA extracted from bortezomib-resistant patient was added to the serum of a different bortezomib-resistant patient, a significant increase in bortezomib resistance was observed (FIG. 29A). FIG. 25C shows the fold change of nuclear density measurements of multiple cell lines and patients derived ctDNA compared to baseline ctDNA alone density. The data of FIG. 25A-25C show that clinical sensitivity to bortezomib of patients can be transmitted to cell lines via ctDNA.

Together, these findings suggest that ctDNA can transmit genetic material that can allow cells (e.g., tumor cells) to transfer information, such as information that defines cell fate to drug treatment. These data also demonstrate that the ZCSs described herein can be used deliver cargo molecules into target cells with high specificity. Without being bound by any theory, it is assumed that the high cell-specificity of the ZCS constructs described herein (e.g., specificity of MM-derived ZCS to MM cells) is based on the same mechanism that allows the herein described transfer of drug resistance information from MM-derived ctDNA of drug-treated patients to MM cells in vitro.

Example 21: ctDNA Incorporates into Tumor Cells that Resemble the ctDNA Cell of Origin This example demonstrates that ctDNA incorporates into tumor cells that resemble the ctDNA cell of origin.

Figure 29B:
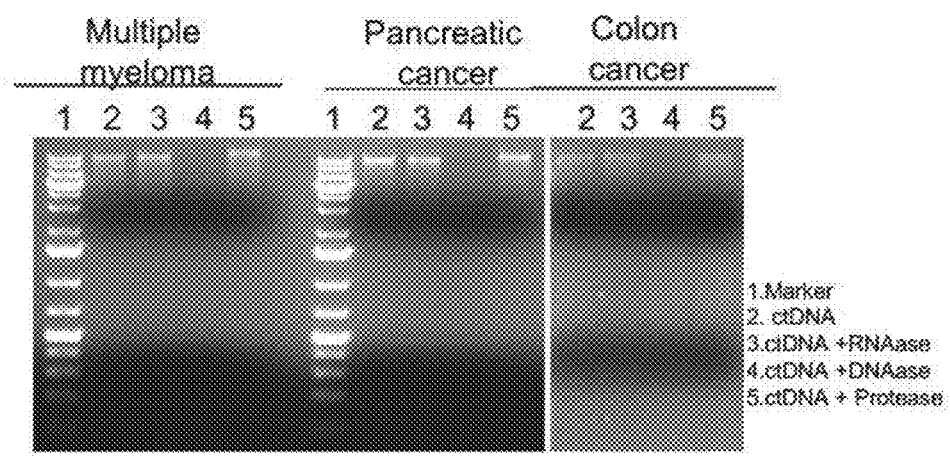
FIG. 29B shows an agarose gel of ctDNA from multiple myeloma (MM), pancreatic cancer (PC) and colon cancer ctDNA without or with treatment with RNase, DNase and proteinases.
Figure 29C:
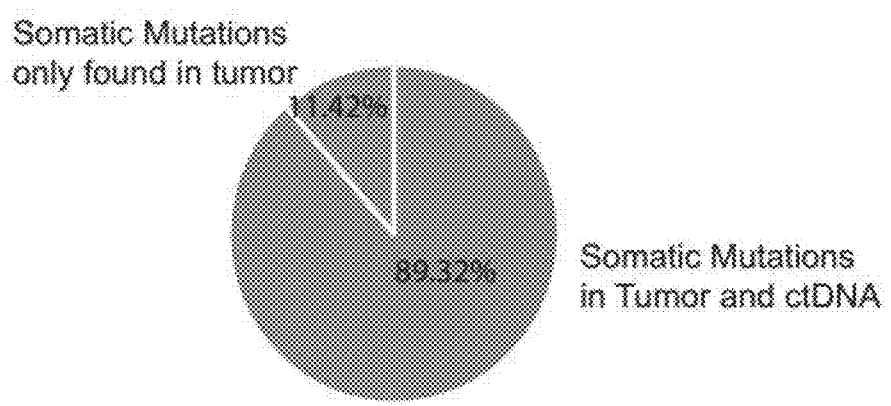
FIG. 29C shows concordance rate single nucleotide variants between tumor and ctDNA measured from pancreatic cancer whole genome sequencing (n=10) and MM exon sequencing (n=10).
Figure 29D:
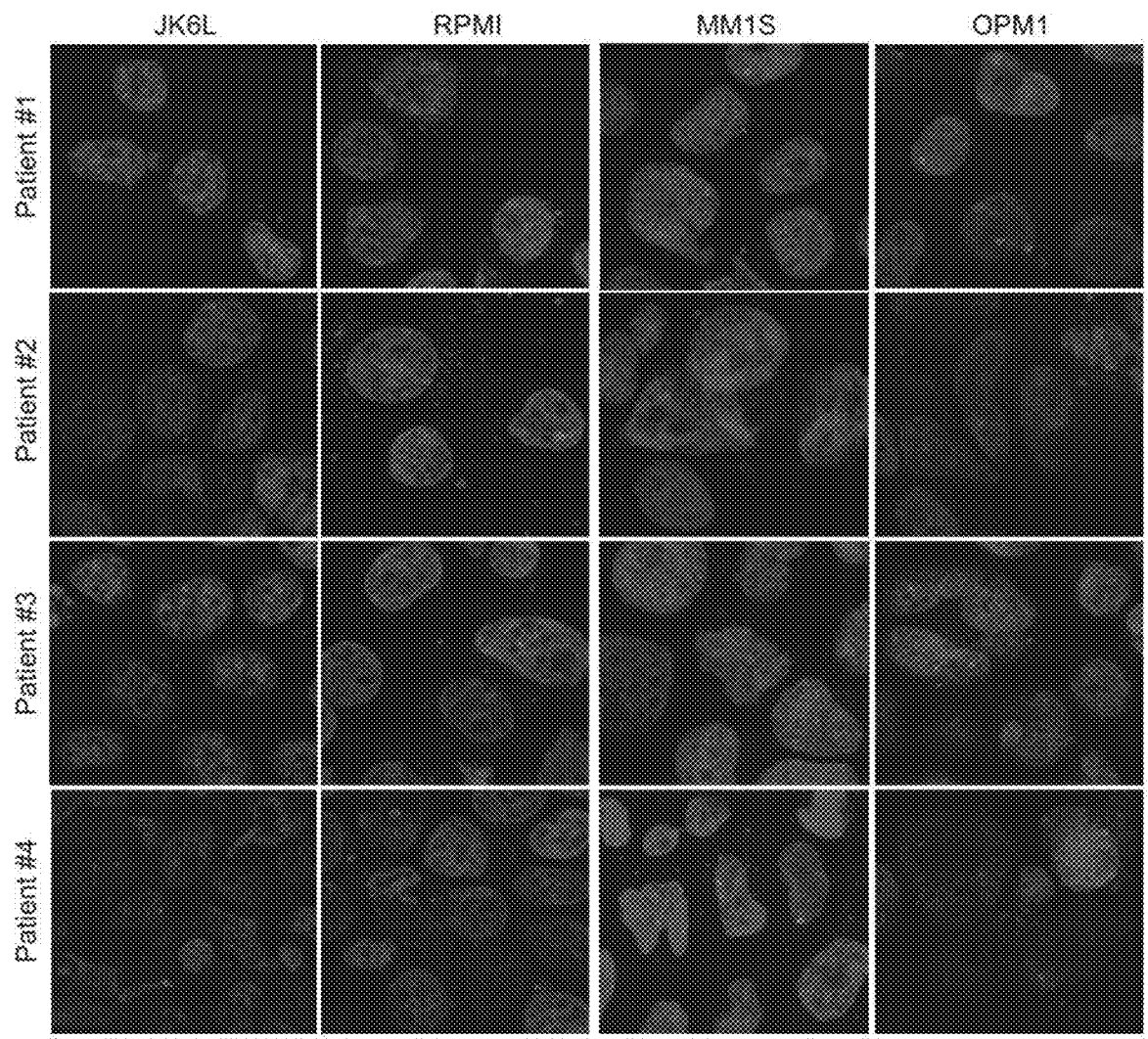
FIG. 29D shows index images of different MM cell lines and ctDNA from multiple MM patients.

To that end, it was evaluated whether ctDNA role in transmitting response to drug treatment (e.g., resistance, sensitivity, etc.) in MM and pancreatic cell lines is due to horizontal transmission of genetic material. Thus, it was first confirmed that ctDNA obtained from the human patients actually represents DNA and reflects the tumor's genome in the respective cancer patients. Such DNA obtained from plasma of patients with MM, pancreatic and colon cancer demonstrated that only treatment with DNase degraded the band seen in these western blots (FIG. 29B). Moreover, ten pair tumor and ctDNA exon sequencing from MM and whole genome sequencing from PC demonstrated a high rate of similarity, in this case of about 90% rate of mutational landscape (FIG. 29C). Based on these findings, horizontal gene transfer (HGT) mediated by ctDNA was evaluated using rhodamine-labeled ctDNA of 4 MM, 3 PC, 3 colon cancer, and 1 lung cancer (LC) patients, which was then introduced in the culture of the different cell lines MM1S, ASPC1, HCT116, and A549, respectively, that matched the ctDNA's tumor type (FIG. 25B). FIG. 29D shows index images of different MM cell lines and ctDNA from multiple MM patients.

These results demonstrated that after 24 hours, ctDNA localized in the nucleus at high levels in most experimental conditions. It was also observed that not every single ctDNA was captured by cancer cell lines, suggesting that some ctDNA fragments may have inherent characteristics that may allow for migration and transfer between cancer cells, e.g., allowing an exchange of information.

Figure 26A:
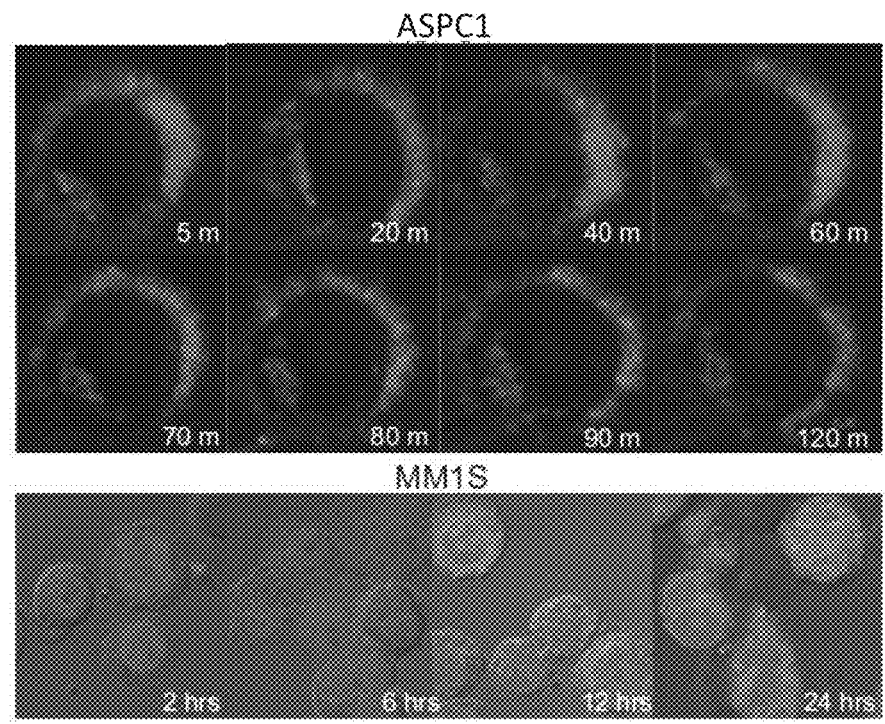
FIG. 26A shows time course measuring demonstrating cytoplasmic and nuclear localization of rhodamine-ctDNA in ASPC1 and MM1 cells. MM: Multiple myeloma, CC: Colon cancer and PC: Pancreatic cancer.

Subsequently, the length of time required for ctDNA to reach the nucleus in a solid (PC) and liquid (MM) tumor cells was evaluated. Using the pancreatic cell line ASPC1, it was identified that ctDNA from the PC patient targeted the cell membrane rapidly (see e.g., top left image of the ASPC1 panel of FIG. 26A, showing localization of rhodamine-labeled ctDNA at the membrane and even inside the cell), and internalized within minutes to then reach the nucleus about 10 minutes later. Moreover, MM1s cells (denoted by image panel labeled "MM1S") took up the ctDNA within 2 hours (very left image of the MMM1S panel of FIG. 26A) and showed internalization of the ctDNA in the cytoplasm about 6 hours later, reaching the nucleus as early as 8 hours with a maximum nuclear localization at about 24 hours (very right image of the MMM1S panel of FIG. 26A).

Example 22: ctDNA Preferentially Migrates to Tumor Xenografts Resembling the ctDNA's Cell of Origin This example demonstrates that ctDNA preferentially migrates to tumor xenografts resembling the same tumor type they originated from, which can be referred to herein as "tropism".

Figure 30A:
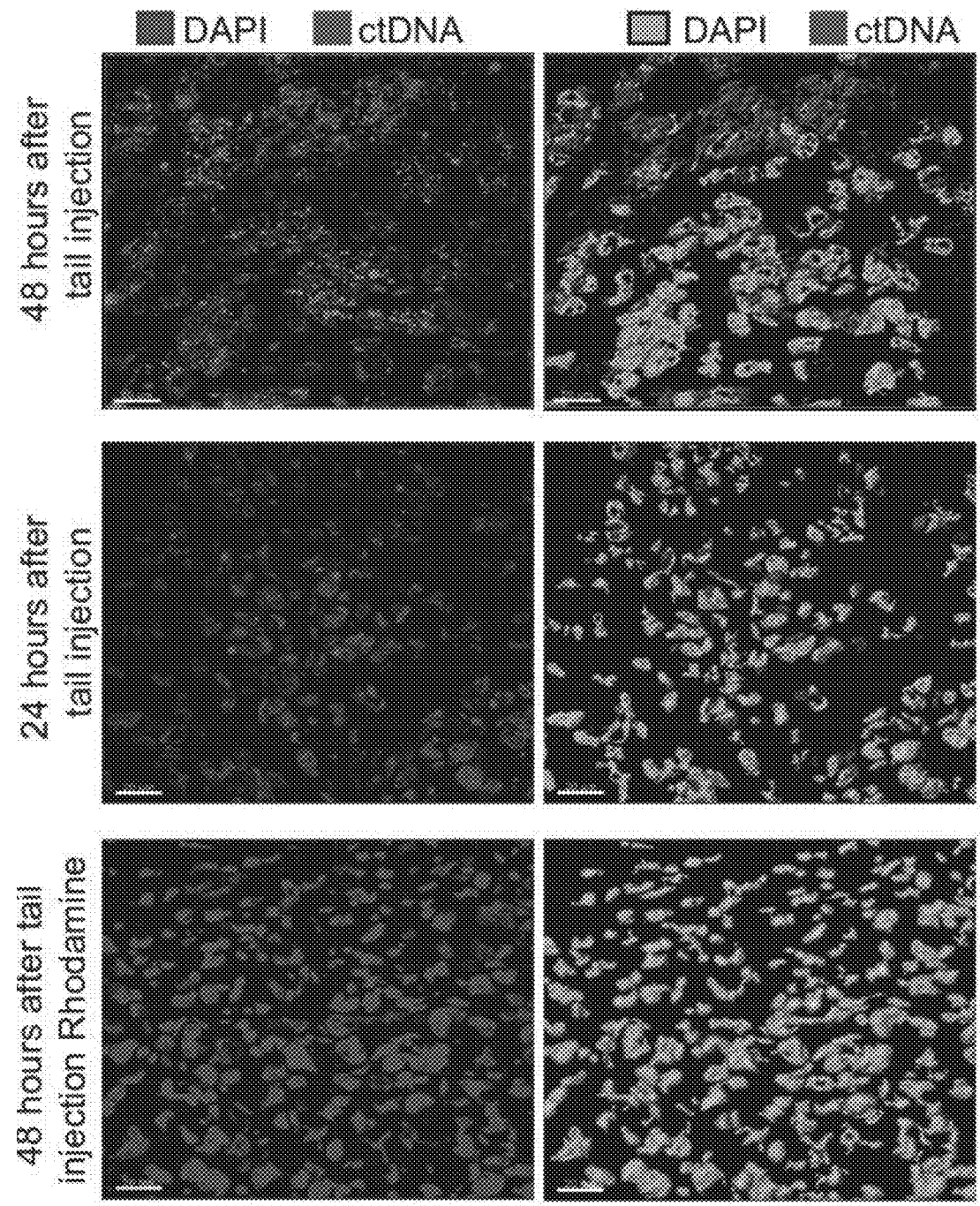
FIG. 30A shows confocal microscopy images of the pancreatic cancer tumors from mice that were tail injected with rhodamine-pancreatic cancer ctDNA. Tumors were harvested at 24 and 48 hours post injection.

For this experiment, a xenograft model using a human-derived pancreatic (MT5), MM (MM1s) and Colon cancer (HCT-116) cell lines was developed. Prior to performing all tumor xenograft experiments, a pilot experiment was performed to determine the timing of the highest concentration of ctDNA at the tumor site. To that end, 3 mice bearing PC xenografts were injected rhodamine-labeled PC-derived ctDNA via the tail vein. This study identified a maximum tumor localization of the rhodamine-ctDNA construct at 48 hours post-injection (FIG. 30A).

Figure 26B:
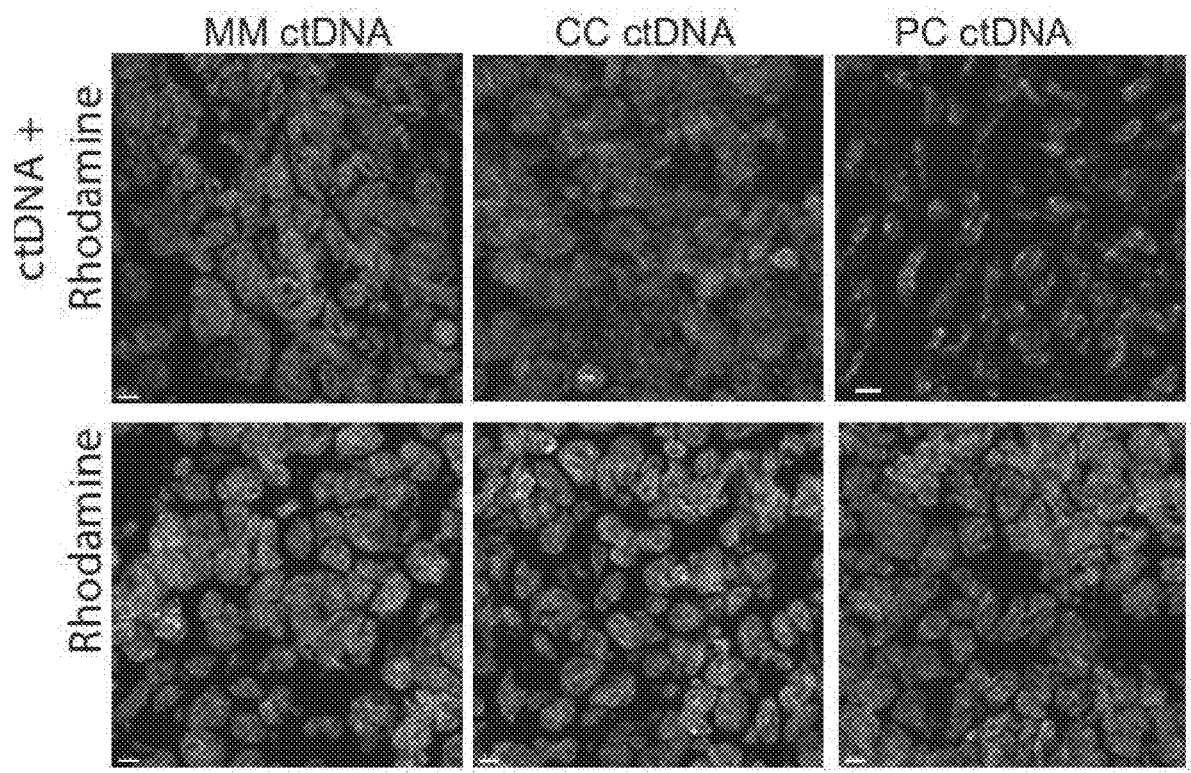
FIG. 26B shows index examples of tumor localization of rhodamine-ctDNA 48 hours after tail injection (n=3).
Figure 30B:
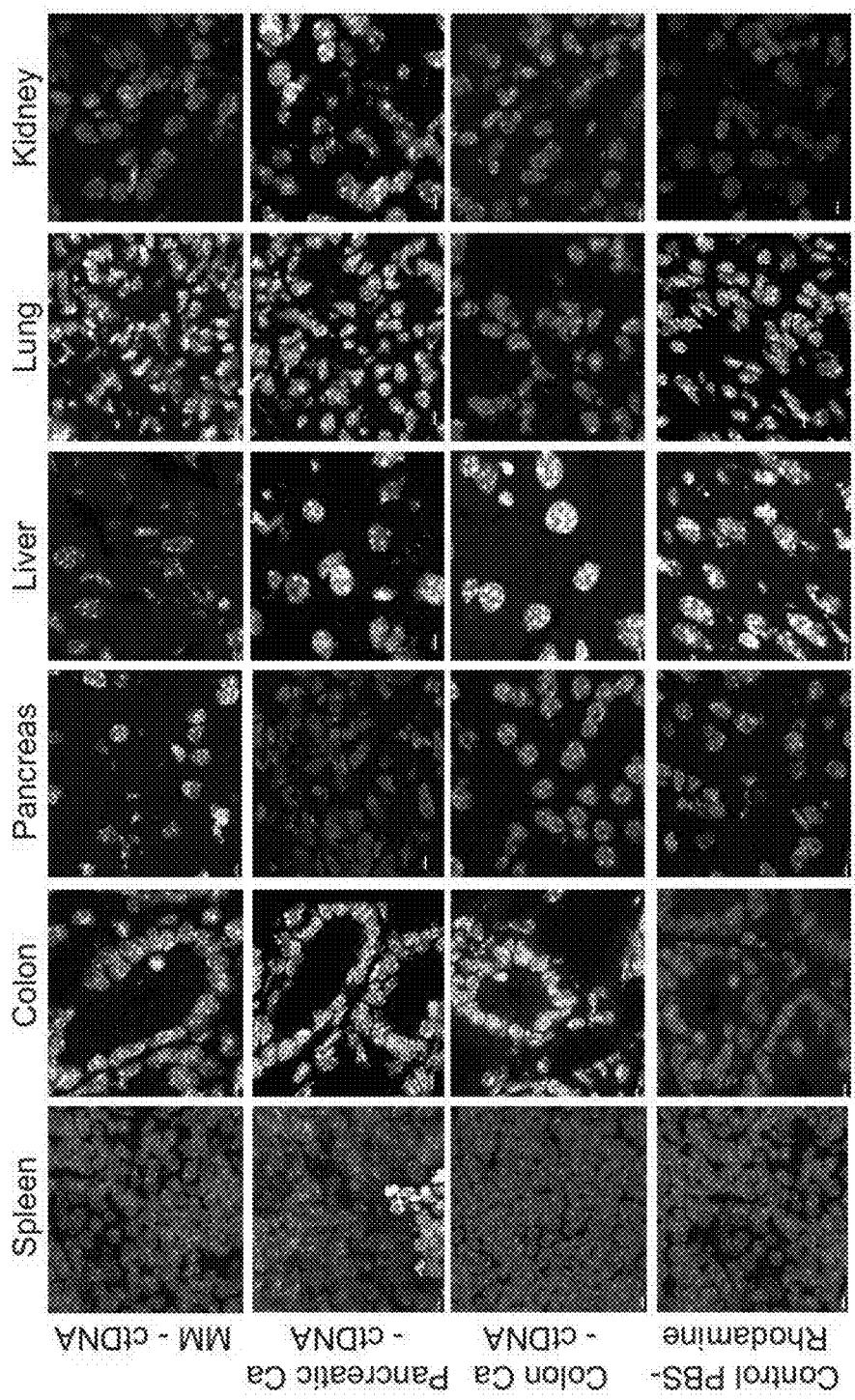
FIG. 30B shows index images from different organs of xenograft-mice injected with rhodamine-ctDNA (MM, Colon and pancreatic cancer) 48 hours after tail injection (n=3).

Subsequently, mouse tumor xenografts of MM, PC and CC (n=5 per tumor type) were injected with the rhodamine-ctDNA (ctDNA obtained from patients suffering from the respective cancer) with corresponding diagnosis (n=3 per tumor type). Two control xenograft mice were injected rhodamine alone as control. After 48 hours, tumors and different organs (liver, spleen, lung, kidney, colon, and pancreas) were harvested and frozen sections were made. Confocal microscopy exploring concentration of labeled ctDNA demonstrated a high concentration in the tumor compared to control mice (FIG. 26B and FIG. 30B). Evaluation of the biodistribution of ctDNA did not show any immunofluorescence signal in any other organs, demonstrating the high specificity of a given ctDNA to cells of its own origin.

Example 23: ctDNA does not Incorporate into Cells that are of a Different Cell Type than the ctDNA's Cell of Origin This example demonstrates that ctDNA does not, or not significantly, incorporate into cells that are of a different cell type than the ctDNA's cell of origin.

Figure 26C:
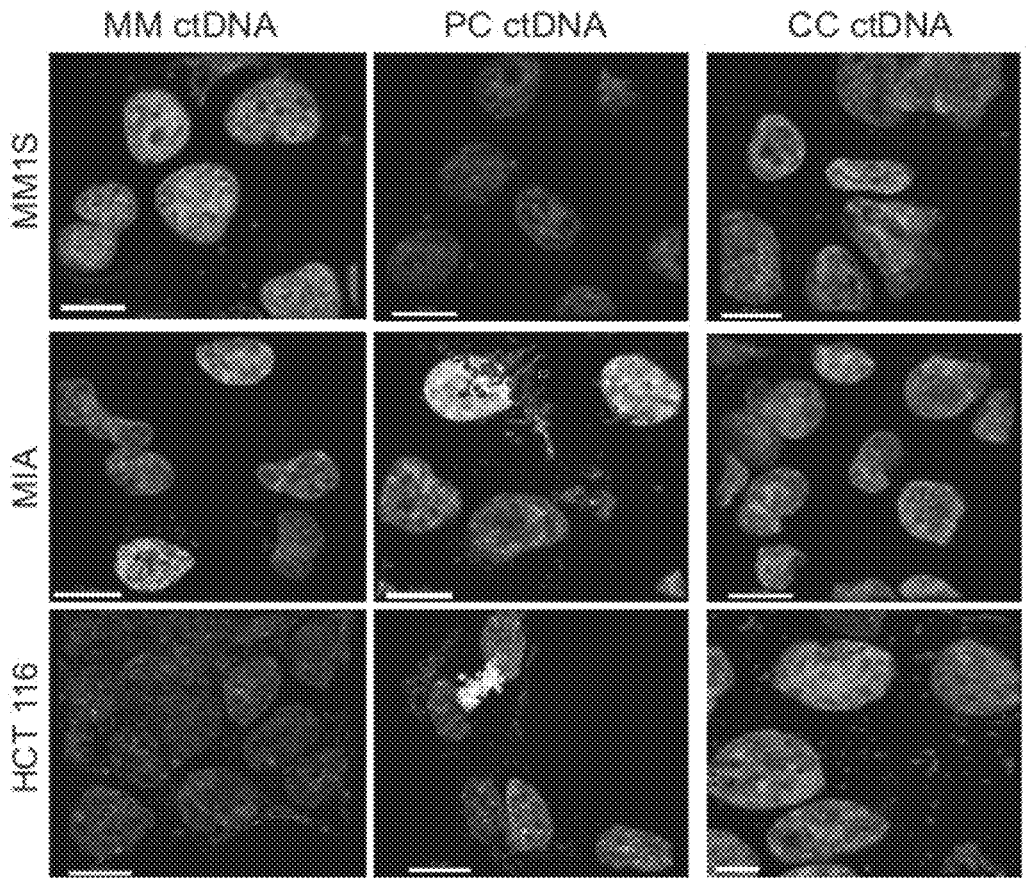
FIG. 26C shows indexes images in cell lines matching or not the patient's cancer type.
Figure 26D:
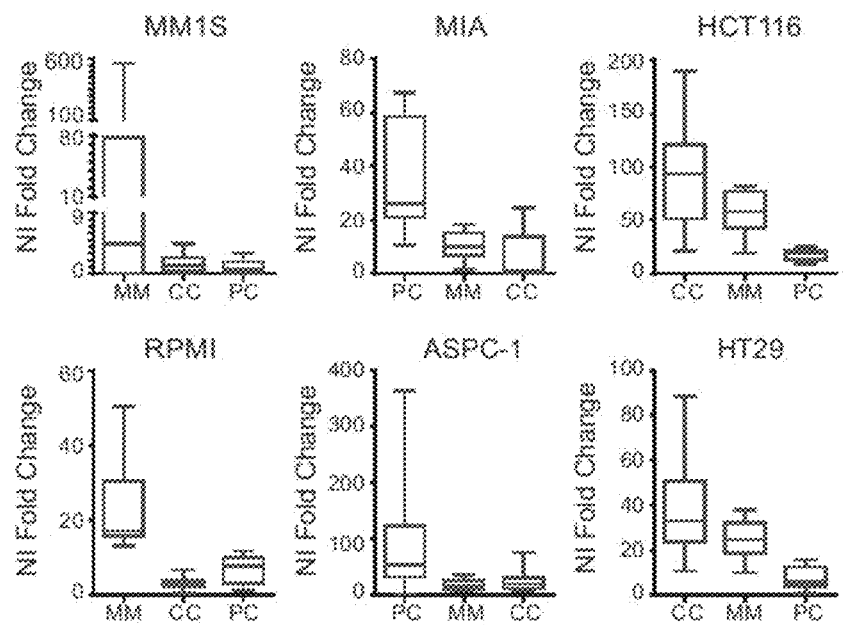
FIG. 26D shows fold change of ctDNA nuclear density measurements in cell lines matching or not the patient's cancer type.

Circulating tumor DNA's (ctDNA's) specific targeting of tumor cells raised the possibility that ctDNA can have a selective tropism for cells that are similar to the cell from which the ctDNA originated. Hence, this was tested by performing a co-culture of cell lines that mismatched the diagnosis of the patients from which ctDNA was extracted. Co-culturing 2 MM cell lines with ctDNA derived from PC, LC or CC patients showed that ctDNA clustered on the periphery of the cell membrane and failed to get internalized (FIG. 26C and FIG. 26D). Similar data were obtained in other experiments when cell pancreatic and colon cancer cell lines were co-cultured with ctDNA extracted from a mismatch tumor type.

Figure 26E:
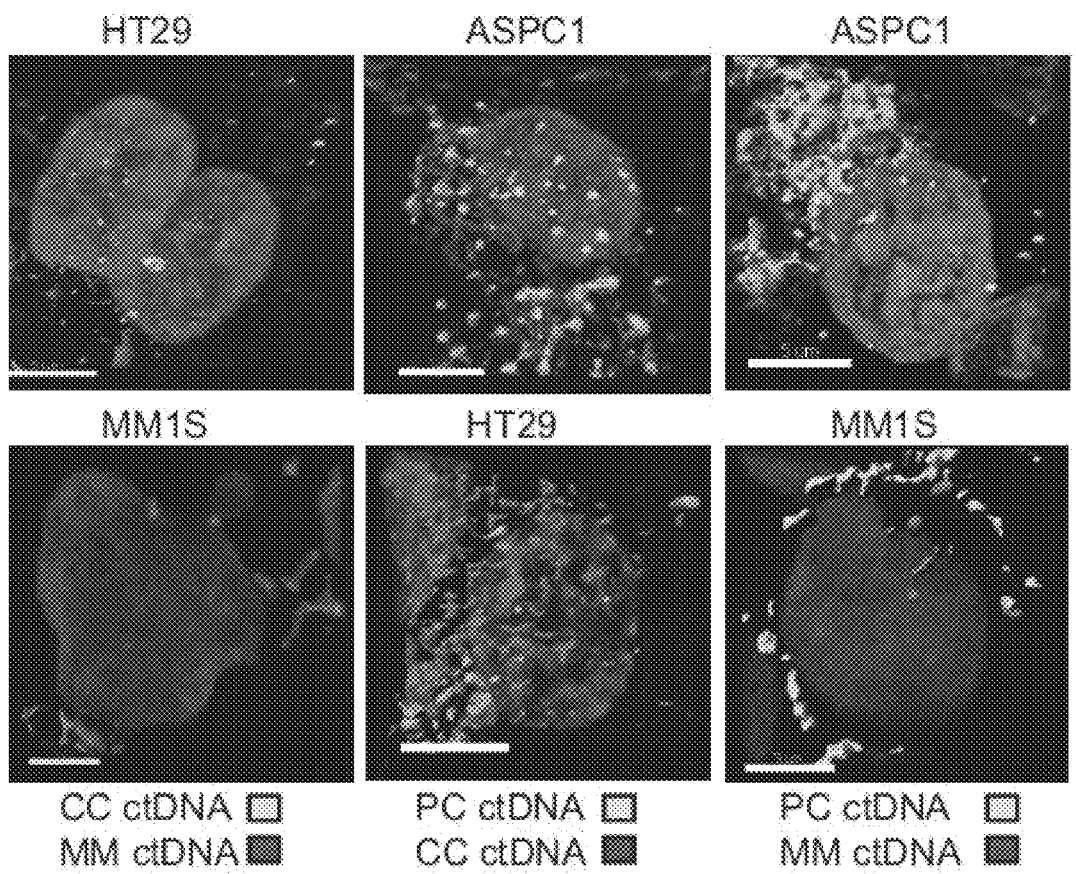
FIG. 26E shows indexes images of coculture of matching and unmatched tumor type ctDNA and cell lines.
Figure 26F:
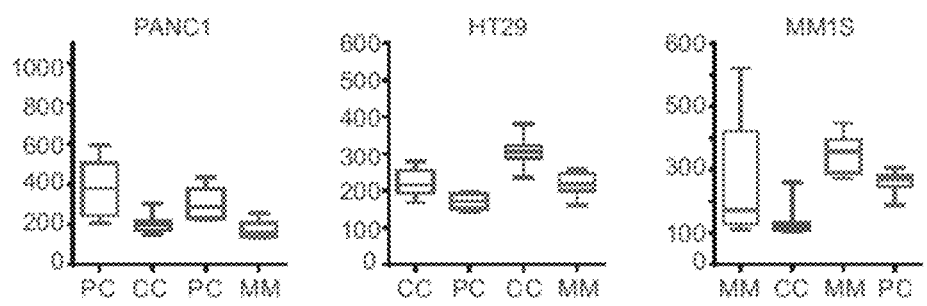
FIG. 26F shows fold change of nuclear density measurements of coculture of matching and unmatched tumor type ctDNA and cell lines.
Figure 26F:
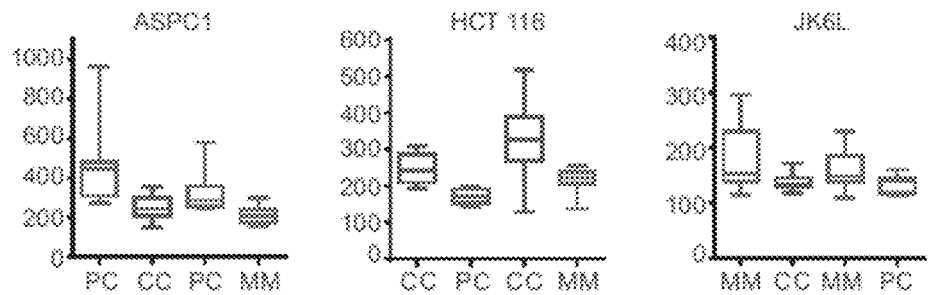

These surprising and unexpected findings were further validated by adding to the culture media containing ctDNA from patients that matched or mismatched the tumor type of the cell lines and measure ctDNA's nuclear localization. After labelling ctDNA with either CY5 or Rhodamine, ctDNA was co-cultured with MM (MM1s and JK6L), CC (HT29 and HCT-116) and PC (PANC1 and PANC1) cell lines for 24 hours. FIG. 26E and FIG. 26F show that when ctDNA origin and cell line tumor types matched, ctDNA significantly accumulates in the nucleus of the cell. And, on the contrary, when tumor types of the cell line and ctDNA were mismatched, the ctDNA remains outside of the cell.

Figure 31A:
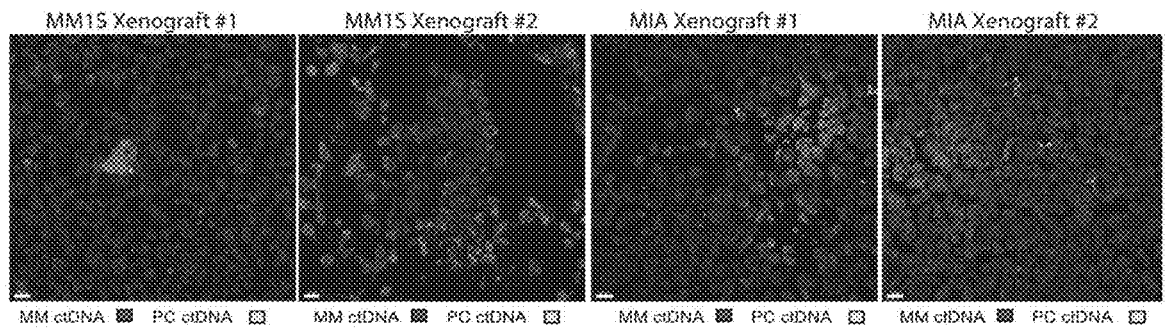
FIG. 31A shows confocal microscopy of the MM or pancreatic cancer tumors from mice tail injected with rhodamine-MM ctDNA and CY5-pancreatic cancer ctDNA.

To recapitulate in vivo the ctDNA's property for specific cell targeting of cells of similar origin (tropism), the selective tropism of ctDNA was tested in 2 xenograft models (MM and PC). Triplicate experiments were performed by injecting in the tail of each animal rhodamine-labeled MM ctDNA and CY5-labeled PC ctDNA. Microscopy of the tumor demonstrated that rhodamine-MM ctDNA (red fluorescence) target MM xenografts but failed to target those of PC. Similarly, CY5 labelled PC ctDNA (yellow fluorescence) highly concentrated in PC xenograft, whereas MM-ctDNA did not (FIG. 31A).

Together, these data provide strong evidence that ctDNA selectively targets cancer cell types similar to its cell of origin in an in-vivo.

Example 24: Chromosomal Integration of ctDNA

This example demonstrates that ctDNA does not only target and enter the cell and nucleus of such cell, can be also integrated into the chromosome of such cells that resemble the ctDNA's cell of origin.

Figure 27A:
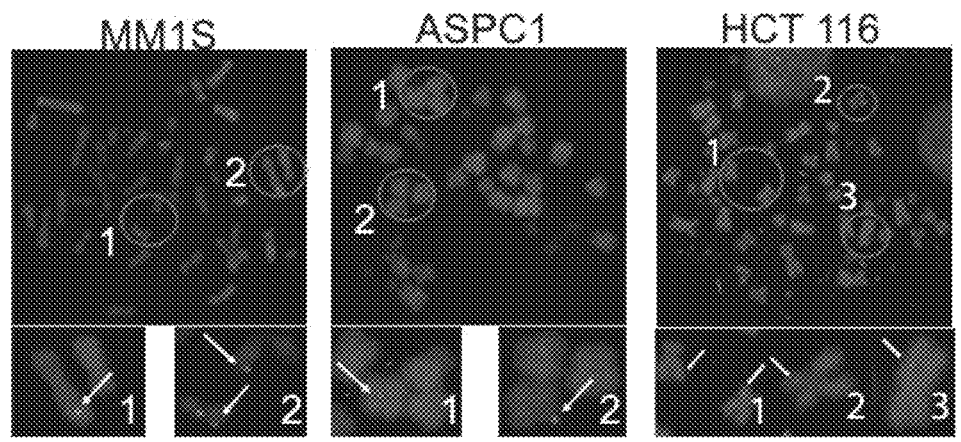
FIG. 27A shows index images of ctDNA integration into chromatids of MM, PC and CC cell lines.
Figure 27B:
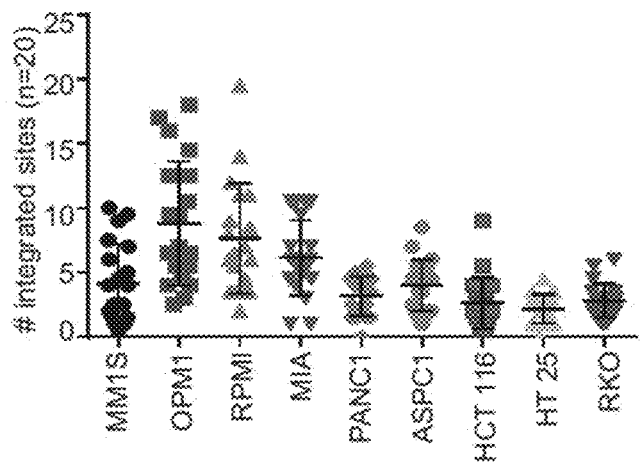
FIG. 27B shows measurement of the chromatids with ctDNA integration (triplicate experiments, n=10 metaphases).
Figure 31B:
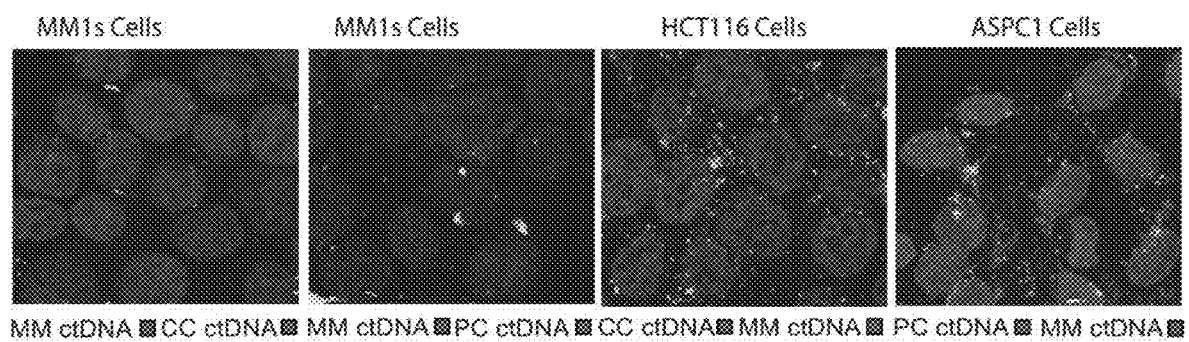
FIG. 31B shows confocal microscopy of MM1s (MM), HTC116 (colon cancer) and ASPC1 (Pancreatic cancer) cell lines culture with ctDNA derived from patients with MM, colon or pancreatic cancer.
Figure 31C:
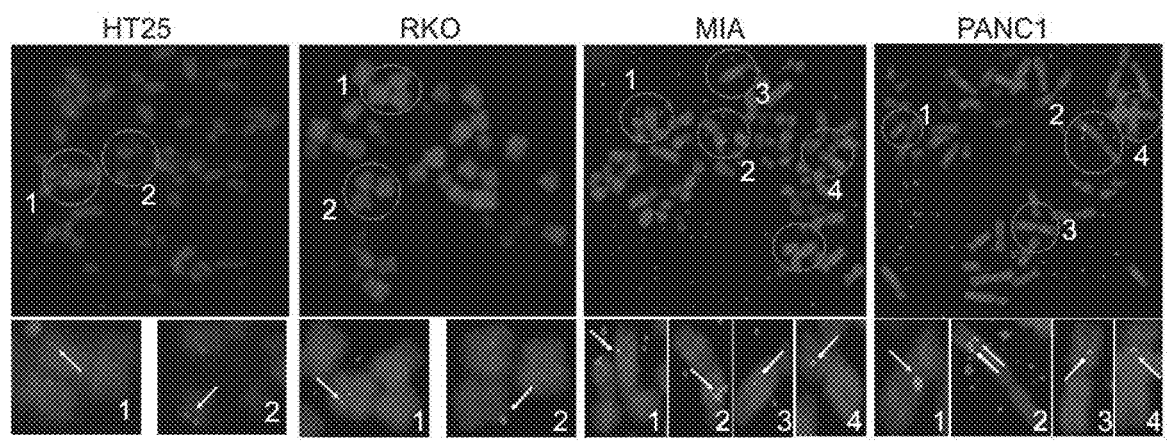
FIG. 31C shows metaphase index cases exemplifying integration of ctDNA in the nucleus of 2 colon (HT29 and RKO) and 2 pancreatic cancer cell lines (MIA and PANC1).

In this study, it was evaluated whether fragments of ctDNA are capable of integrating into the cell genome once they reach the nucleus. To that end, metaphase chromosome spreads of MM (MM1s, RPMI, OPM1), PC (MIA, ASPC1, PANC1) and CC (HCT-116, HCT-11, RKO) cell lines was performed by adding ctDNA to the culture medium (N=3 per tumor type). As shown in FIG. 27A and FIG. 27B, as well FIG. 31B and FIG. 31C, multiple rhodamine-ctDNA bands were identified that incorporated into the several chromatids.

Figure 27C:
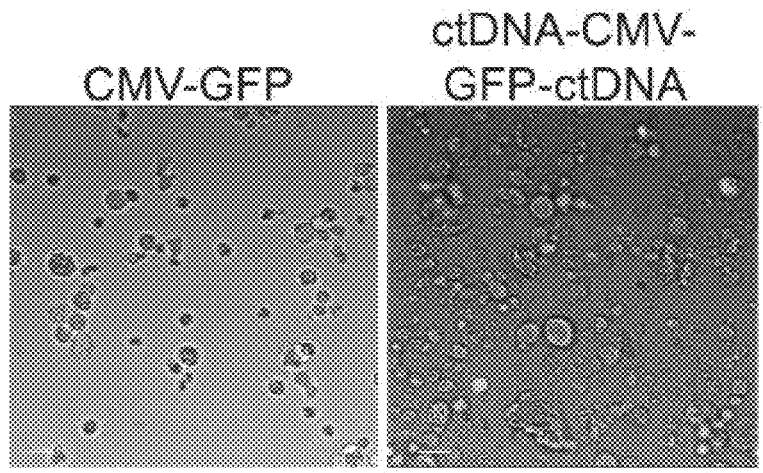
FIG. 27C shows expression of GFP in tumor cells cocultured with a ctDNA-CMV-GFP-ctDNA construct in which a cargo nucleic acid sequence coding for a Cytomegalovirus-green fluorescent protein (CMV-GFP) was flanked by ctDNA sequences allowing for cell targeting and genomic integration of the cargo (CMV-GFP-coding) sequence (right image). The left image (control) shows that CMV-GFP was not expressed in the tumor cells when CMV-GFP-coding cargo nucleic acid sequence was used without ctDNA, suggesting that the ctDNA portions were necessary for cell targeting and expression of the cargo nucleic sequence.

To further confirm the ctDNA's integration in the cell genome, whole genome sequencing (WGS) was performed as described herein of 3 different experimental conditions: cell lines (MM, PC and CC), ctDNA extracted from patients with cancer diagnosis similar to cell lines, and ctDNA co-cultured with their corresponding tumor cell line. The sequence of ctDNA fragments was generated by de novo assembly, which led to about 17 million contig sequences (contigs). The list of contigs was then filtered by selecting those with sequences with more than 99% sequence homology in MM, PC or CC and the capacity of their centroid regions to cluster into each tumor category (n=180 contigs each). After mapping the sequences of this contigs with the K-mers present in the co-culture ctDNA-cell line and cell line alone, ctDNA fragments were identified that integrated into the cell's genome. Circus plots demonstrate the insertion of several contigs and its corresponding insertion site in MM1s and ASPC1, cell lines. Finally, the capacity of ctDNA to transport and integrate genetic material into target cells, was further validated by evaluating for GFP expression in MM1s cells that were coculture with MM ctDNA that had introduced in the middle a linearized CMV-GFP vector, such that the CMV-GFP vector encoding for GFP was flanked on each site by a MM ctDNA molecule). FIG. 27C shows expression of GFP in tumor cells co-cultured with a ctDNA-CMV-GFP-ctDNA construct in which a cargo nucleic acid sequence coding for a Cytomegalovirus-green fluorescent protein (CMV-GFP) was flanked by ctDNA sequences allowing for cell targeting and genomic integration of the cargo (CMV-GFP-coding) sequence (right image). The left image (control) shows that CMV-GFP was not expressed in the tumor cells when CMV-GFP-coding cargo nucleic acid sequence was used without ctDNA, suggesting that the ctDNA portions were necessary for cell targeting and expression of the cargo nucleic sequence.

Thus, these data indicate that ctDNA can mediate horizontal transmission of genetic material between cancer cells. Thus, these data indicate that ctDNA as well as nucleic acids derived therefrom as described herein, e.g., ZCSs comprising a targeting sequence and an integration sequence, can be used to transport a target gene (e.g., a therapeutic target gene) into a cell in a highly cell-specific manner, potentially obviating the need for using viral vectors or other conventional methods to introduce a gene of interest into a target cell.

In addition, the specificity of cell targeting of ctDNA was investigated comparing the number of insertions in conditions in which ctDNA and cell type match tumor diagnosis with those which ctDNA does not match tumor type of the cell line.

These studies confirmed a significant increase of ctDNA insertions into a genome of a cell that matched the ctDNA' cell of origin, e.g., the same cancer type, etc., validating ctDNA's selectivity of tissue targeting.

Example 25: 5' and 3' Transposons Mediate Insertion of ctDNA

This example demonstrates that 5' and 3' transposons can mediate insertion of ctDNA into a genome of a target cell, e.g., a cell of the same cancer type than the cell the ctDNA is derived from.

Figure 28A:
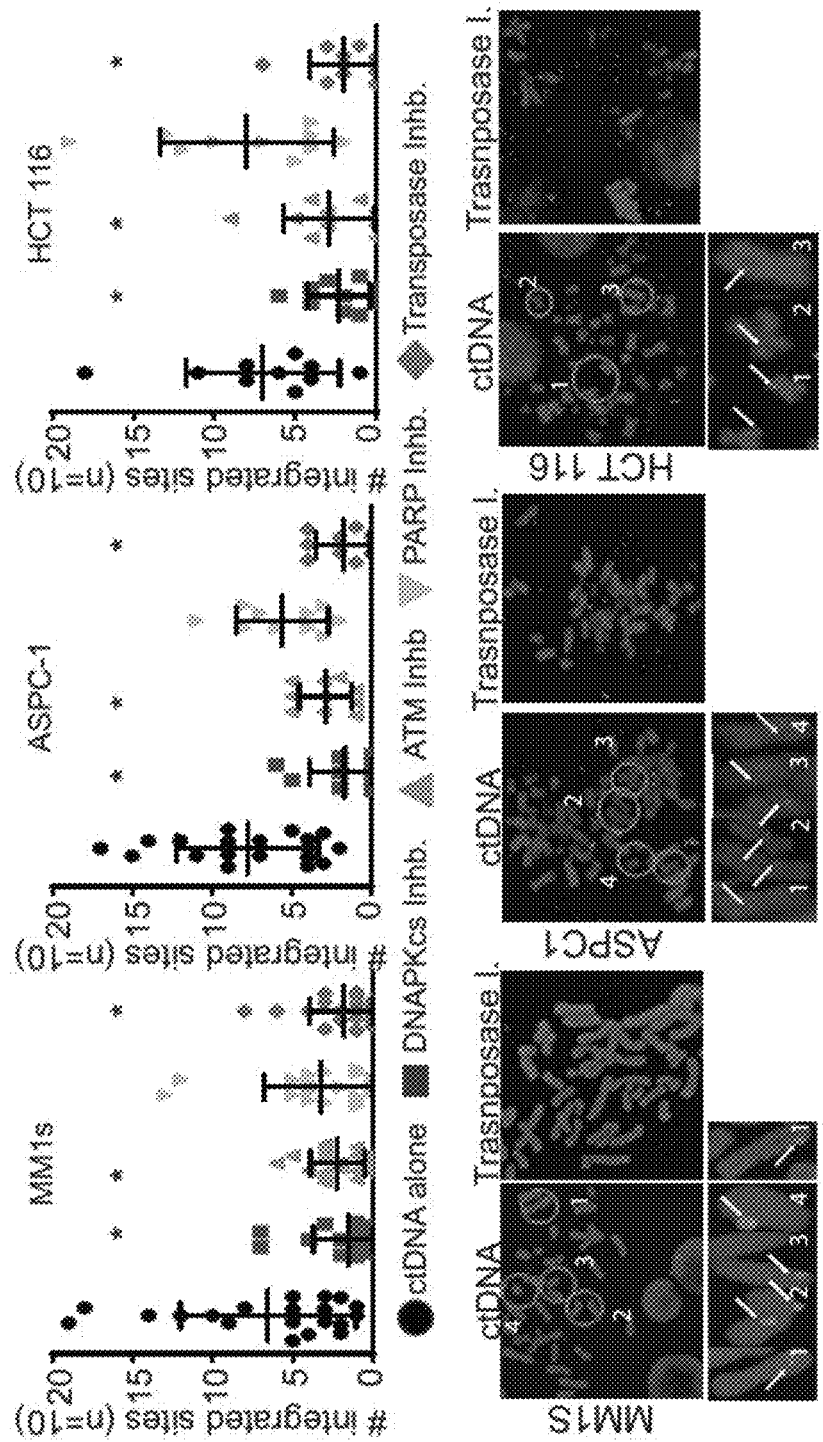
FIG. 28A shows the number of the chromatids with ctDNA integration (triplicate experiments, n=10 metaphases) after treating cells (MM1S, ASPC-1, and HCT 116 cells) with KU-55933 (ATM inhibitor, 10 μM), DNA-PKCS inhibitor I (DNAPKcs Inhibitor, 30 μM), NU1025 (PARP inhibitor, 200 μM) and raltegravir (MANASE SETMAR/Integrase, 100 nM) in inhibitor.

Transposable elements (TEs) can play an important role in the mechanism of HGT observed in prokaryotes and few cases of eukaryotes (insects and plants). Thus, it was investigated whether inhibition of transposable elements could reduce or prevent ctDNA integration into chromatids. To that end, cells were treated for 2 hours with raltegravir, a transposase inhibitor, before the addition of ctDNA into culture media. For controls, inhibitors of ATM (KU-55933), DNPkc (DNA-PKCS inhibitor I) and PARP (NU1025) were used. FIG. 28A demonstrates the level of incorporation of rhodamine (from rhodamine-labeled ctDNA) bands into the chromosomes in MM (MM1S), PC (ASPC-1), and CC (HCT 116) cell lines. The data shows that integration of ctDNA was significantly reduced by inhibitors of DNAPKcs (DNA-PKCS inhibitor I, 30 µM), ATM (KU-55933, 10 µM), or a transposase inhibitor (raltegravir, 100 nM) when compared to control or PARP inhibitor (NU1025, 200 µM)-treated cells, confirming that transposable elements can play a role in inserting ctDNA into a cell's genome. Based on these results, a series of experiments was designed to identify the sequence characteristics of the ctDNA fragments that may play a role in integrating into the cell's genome. To this end, 5 MM and 10 PC ctDNA samples were sequenced that have been previously ligated to a PACBIO probe to label the 5' and end 3' of each ctDNA fragment. Following an algorithm for identification of MM and PC sequences, it was investigated which ctDNA fragments can play a role in inserting ctDNA into the cell genome by comparing the contigs list generated from the ctDNA de novo assembly with the sequences identified as ctDNA insertions from the co-culture experiments as described herein. These analyses identified contigs embedded or not in the cell genome. Using multiple software capable of detecting and classifying TE content in DNA sequences, ctDNA fragments were divided according to their capacity for integration into the cell genome, the content of TE and, TE localization in the contig sequence. The analysis demonstrated that ctDNA fragments integrated in the cell genome were highly enriched with TE and their localization was primarily concentrated towards both 5' and 3' ends. In addition, ctDNA fragments that did not insert demonstrated a significant lack of TEs and did, when present, not significantly localize in any of the ends of the ctDNA fragments. The combination of the vital role of TE in HGT observed in prokaryotes and plants, and findings described herein in cancer cells suggest that TEs may play a significant role in gene transfer between cancer cells. Thus, these TE sequences can be used in ctDNA or ctDNA-derived constructs were transporting a nucleic acid or gene of interest (e.g., therapeutic, apoptotic genes, etc.) into a target cell.

Figure 28B:
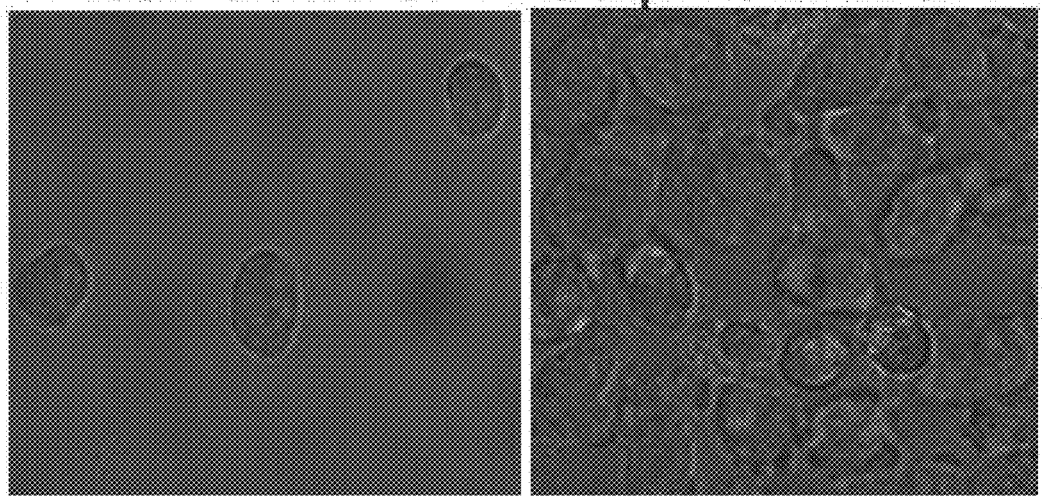
FIG. 28B shows GFP expression in cells coculture with a TE-CMV-GFP fragment.
Figure 28C:
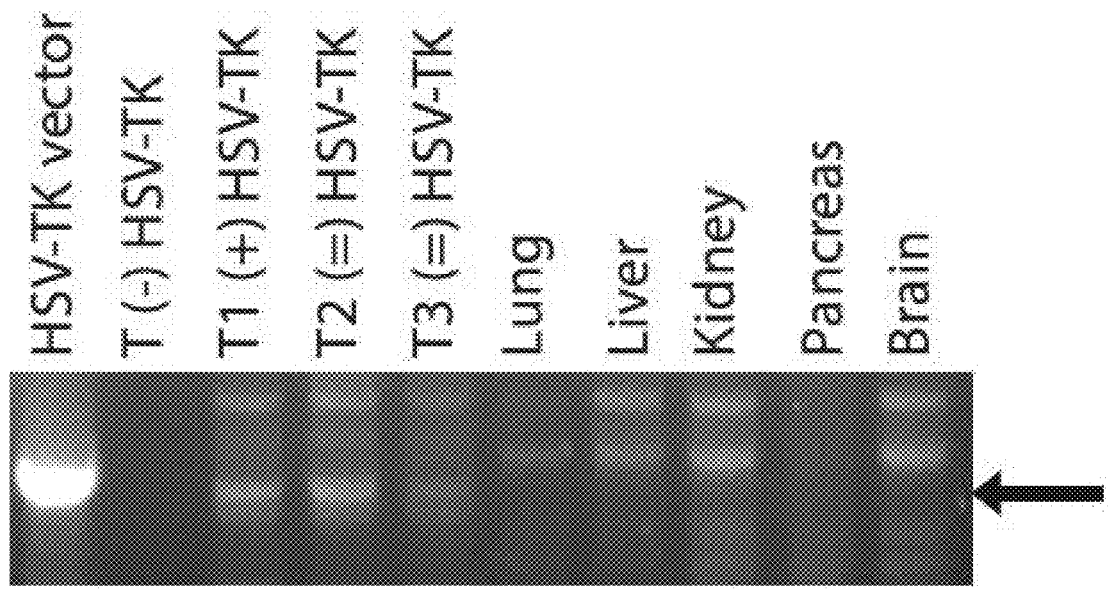
FIG. 28C shows PCR of DNA extracted from HSV-TK vector, tumors controls or tumors of mice injected with TE-CMV-HSV-TK and organs of 1 index case of a mice injected with TE-CMV-HSV-TK.

Subsequent analysis of the integrated ctDNA fragments allowed identification of two types of TEs that made up for about 40% of transposable like elements present in those fragments. About half of those were MIR retrotransposons, and the other half were ALUsq. Interestingly, MIR is a transposable element (TE)-derived insulator very similar to the *Drosophila* gypsy element; a TE widely uses in gene editing. To further validate the role of MIR in transferring genetic material between cancer cells, the TEs were chemically synthesized and ligated to a linearized Cytomegalovirus-green fluorescent protein (CMV-GFP) fragment (FIG. 28B). After ligation and purification, the TE-CMV-GFP DNA was placed in a MM cell line culture (MMs1) and live imaging was performed. The results demonstrate that within 12 hours, MM1s cells expressed GFP, suggesting that the synthesized TE is capable of transferring and integrating genetic cargo material into the cell genome (FIG. 28B, right image, green fluorescence shows GFP production within cells). This result was further validated in vivo when the TE was ligated to a CMV-HSVTK and injected into the tail of MM xenograft mice. PCR of the tumor and different mice organs detected HSVTK gene exclusively present in the tumor tissue (FIG. 28C). These results, combined with high concentration of TE in ctDNA and the lack of integration observed in raltegravir-treated cells, suggest that TE play a central role in mediating ctDNA horizontal gene transfer between cancer cells. Thus, nucleic acid constructs comprising such transposable elements can be used to express genes of interest in cells in a highly cell-specific manner, while obviating the need to viral vectors and/or gene editing tools such TALEN or CRISPR.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (282 sequences)

SEQ ID NO: 1 - DNA, 7120 bp, Artificial Sequence
  Description of Artificial Sequence: Synthetic polynucleotide
gaggatggcttgagtttagaggatggaggttacagtgagctatgattgtgccactgtacttcagcctgagggacagagccagaccctgtctcagaaaaacctagaacaacaacaaacagagagaggagcctggacggactgagcaatattagtgtccaggagctgctgtagtgatggcttacaacatcaggaatttattctctcacagttctggaggccacaagtccaaaatcaaggtgtgggcagaaatgcactccctctgcagactcttggggaggattcttgtttcttccagctctgcgactgtggtgcctgcagccattggaaccagctctgcacggctcagacctgggtgatgaggacacagctttgcaggtgggcagccacatccctaaggggagactgtgggcctgtggcagggtaggggcaagcagggcaggggctccccattgttgcccctgagctcctggggcttgtggagaaagacaggtggatgcacacatactgcagctccctggatctgagccttggtttccctacctgtgaaatgggcacccaaggcagctcagaagtgtctgggagcatcccctgtgggggaaggtgtggggggctgctgggccacagtcatggggaaccccagtccccctctccatgtgcttccttcaatgctccctgatgccagaagacctgcccctgaacagagaggggcattcttgtgagttccttgtgtgggggtttggtcacagagactccccaagtgcagggcagggtggagggaggctaaagggtggttgaatggacaggagaagagctctctccagtccctcgggtctgggtggcctggggagcatccatttgggcaggcagctggcgtggctggtggctgagccactgtggctcggggaccccaggtgtctcctggacagaaagagccctggtcactcatggctgcagcatagccatggcgacaggaaagtgctgctgtacattgtgctcctggggctggctcccaatggacacccaatggcatctcccccactgtactctgggatgctggcaggggtgatgggcactggggtaagagccttggcaagcccttcgctccctgggtgtgagaccttgggctcctggatgcctgggtttctgtgtcctatttttcccatggaagatgtttggggtgctcccacgaaatggggagggccctggggggtcaggattgtattattaaagccagaaactctggggttccatttttagcacaaggcaggcagcccatgagccacagcccagtggccagcctgtgtgggaggggagtgggggtctgaaggagtgaggatcctgttaccgcaggctccactgcagccccccagggtggccgtgtgggctggacagtgggcactgcaccaggggctctggtgccgaccttgagccatgcatctgatgcctgtgagagtgatctctaggagccactgcacagggggcagatgagggaacccagacatgagacagctgagggcgaccccaacacggagggggcagctgtgtccaggctccactggattccgcagaggacagaacacagctctgactctaggatgtgggctcactgagggtcaggacaggctggggttgggagagggctatgctgcagctgggccacatcccacctgcacccctcagatggcagggcctggacgtccccatccccaccctgacccggtcagtaacagccacaggccagcagcccccagcaaccgctccctccctgaactgcctgggacaggaggtaccatagtctcttctaggcgagagctgctggagccttctttattcttgtgctagaagcccagggtggggagaggagcctgagaacagcccagtgtgggcatccaccttcctgcccactttggaggtctgaatcacctccggccactctcccaatccccaggagccaagaggcttcctggagcaagccgcacctgatctccaccatgggtaggagttcaaggccaggtcaacggggactccacagaggggcctgtgggttagcagcagctgccagtgtccagatggcctcaggggtgggggttggacaatctggaggtcagcagggaattcagcatgaggagacagcccttagggttctggcccagcagccccaggtgctggctctgcactgagtcatgaagtttgtgggccaggggcgttggcctctctctagctggaagtgacttccatcactgctgtcattagcctcccctgcatcaacctgtccctggggtgggagcacagtgggcacagggaccgtcaagcctcagttttccctgctgtaaaatgcatgtgatagtgaggcggtcatgaggcctgaaggagttaaaacctgccttgtgatcaggatggcacctagctcggtgcctcctagcctggtgccaccatccggcatcagagatgaaatacgtctcccaggccccctcccctggcatcctccacactcagctctccatcagccacaccctccagggtgggacaaggaggtcctgagactgatggggacccgacagggctgggcagcaccacctgggcctaggcgataatgggagcctgagtgtggggcctgcagggagggagccattgtttcttgggcttcttagtggctacttccctaaagtctgggagaagcactgctgctcaagaggggacagtgccagcagctccctctgaggctggggtgggcacagcatagggtgtcctcacccccacccacctcccatggaggttcctggctctcttggaggactcctcgctactgtgctgaggctggcaccagggctgaccaggcccaggatggtgttggaccacctgcatccccctgcagcaggcagggagggcactgcagacaccaccctcccacagctgacccctccctggccattgtgtctagggtggcagggtgtgaagcccccacccaacaacctccctcagctcaggggcctttgtgttcaccaccatctgcctcactgcaggttttccctgtgctgggtgggggtgattgcagggagatggttctttggtattccctgggcaggtcattgcctcagcccctgcctggtgtcctggaacagctttgaggagctacatggacaggacaccaactgtctgcagcccccaggtgaggcttggctgctgtgtcccactgcctctgctcctggctgtcaaaaccccatggtaacagcatccagggcgaatttaaatggcaccccaaagaataagagtgggcctgggtgtcactgtagtgactggtggcttgtgacaagtagtgtggcttccgtggtgatgggaaatgacagttccccctgaatctgcactggagagaaggtcctggaagctttcgggcccaccctccagggtctgggtctgcatctctgagagtggctgggtgggaagaagaatcctcactgcctggcagtcgggtttggagctggggagggccgggcctggttagcaacgagcctatcacagtgaaccagagctcaagataaagcgagaggcctagcccagacacctccttccctggtcccagcccctgtgccttggcctgtgcggtggaagccaggctccctcctccaggaagtcttccctgcactgcctgctcacacacagcctctcccagatttctccccatccaggctgagtaggtttcccaagaaggctcctccccgagccaactgcctgcagtcaacattatcacctcccccagtgaacggcagtagtgtttttcgtcttcagcagtggcctctggaggggtcctagcaggtcggggagagaggtctgagttagccccacgtgaaaggcagcccatgcctcttctcccagcaacccccagcagcaatttccacctggctgaccccacccagctcacagagctgcccagctggttgtcctcgtggttgattggggggaaggggctgttacctcccggtcccctccaggctgagacaagagccctgtgggcctggatcttgcagatgggacccccacccacaggctctccaggtggatgcccaccctgggctgttctcaggcccctctccccacactgggcccacacccagaagggaactccatgtacccctgccgatctgcccatctgcccatctgagcctcaggggtcctgggcactgagagctgggctgggctgagctcaggtatacactgtcattggggacagagaggggatgctgaagtgggtgcttctgcgtggggcctgcctggaggatcgccacagcaggtgcacccagcagccagaccagcttctagcagaataagcgcactgtcacaggggtatgtgagctgaggctgggggcctggaggtgcagggggaggagttggggagatgcagaggccgcaaagatgtcccaaggccctaagactctggtgagggaatggaggagccagcactggtggggaagtgaggagggggagctgggtggcctggctctgagcgggacacacggtctgcgcccacacttgagctgtgctgtggagccccagtccccacctgggcatgtcctgtcctctgaagcacagggattcctcatcctcagctctgacccctcatctccaactgttgggatgatgagtccataggcagagccagcctcacaggggacccaaaggccagttcagatggacagcaactggaggtcccaccgggcacacacacacactgtgcagaaagctaatgcactgtttatttgggggattggggggaagcaccgtgccgctgctcactggtagccagccagctgcaggatggtggggtagcaagtacgatgggccatgcacttctggcggtcgatgaagagactgttggtcatggcggtaacgtccttctccaggctcatgtggatgtcctcgaggttgcaaagggactgctccccttctagaagcttctcccgcagcgctgtgatggacatgttcagctcctccacctcactcaccagcttggggatgttggggggtgtgagctggggctggggagggcagaagtatgcacctaccggggtgcaggggacccaaaactcccaatgggagctggcaggaggtcctgggaagacgccatgaaaggatcccaccaggaaagcggctctagggcagagcataaattacgagggtcctcccagggagcacggtcctgagtgggaatgagtgacctgcgtgcaatctcgaccctggcagaacaggactggcctcagccgacaaggctcagttctttccattcctgatatttgacggaaggaggcacccagttccttgaaggaactgaggggcaggaaaggaagaaaggtacttaggctcagaaggggccaccaggcatccattaacaagggaaacaaaaggacggcccatctatgcctatagcccaggcgtaggtcatactttccaccagaggtggggacagcaccctcagggcagcagggaatggccctccctggcctctctggccccgtggcctccaggagctcaccttgtctgaaggagcttcttcccgggaagacgaggtagcacagggtggggtgagaccacgtgggcacaggtccctggcactgagaggcacccgacccatgacctgcccagtgtcatgtctatatcatctgtgtgtttaaggtgtgcttgcatgttgcgtgtggccgcaaagtctccctcccctctcagcacctgcgggggatgtgtgtgtggagattggagtgtttactggaaagggtcacagcgaggaggtggacgggggcaagtgggactgcctcagaggcccaggcagcacctgaactgggctgcattgccacacagctccatgttgggccagtgcaagcgcaggtacagaagggtctgggctatgtgcagaggtgcctccttgtccttgatggcctccttcagtgccgccacgttgtttctgatctgtgatttcccgcagcatctacagacaggacagtgccccttaggcctgtgcccccatgcccgggcatatcgaatgcggagaccaggctggtcctacccaggtcctggggctgtgtccagagggtggtcctgaccagtggccctggggaggcgtggatgaggggaacaatgtgcacggggcccccagtgggctctggagagtcaggcagcctgttttatcttagctctggtccaagaacccccatccttggtggtcaccaggacccaaatcctgctcaaggactggggactcagaggtggtaaaggccatgctgaggccctagagtcagagccctgcctgccaggccaggactcttggggacctcccggtcggtcaatgctcccgagaccacctcctgcctccatcctccccacagctcctccagctcagtcatgggggttgcaacaccctgtgatcatacccagtgtcacctggttttacataggtttacggagaggtgacacttgcttctggggtccttcgggataagtgggacagaggagaaaggtattgagggcccaggccatgtgatgagagggggcagagtggtgggcaggagtgggagccatcttcggggttgagggtgccccaccttgtgcaggtggtgctgcagcttgtgccgcgtgtcctccagctcctcacagcggcgcccgaaggccaggttcacggcgtcacactggagtcccaggtcctcggaggtgtcgcgaaagatgcagtccaccagcacccacaggttggccgagtccaggtgctcgcgctgggagcggcacagattgtcctgcgtgaacttggtccaggtctccggggtggaggcgctgcggggcaggagacagccaggagagggtcagggaggctctgccaaaggctgggggccctgccgcgcccccattccctgtctgcaccccatgctcctggaggaactgcatggactccaatgcaccccgtgcagacccacgaagcccagtcccccaagctccctgcctccgagtgccccccgcccacaactcccctgagtccacccacaccctacccaccccgggcacttagtcccctcctgcccccgcgaccccgttcccagcaccgctgcccccgaggccccctctgcagcacctccgtcccccgcag

SEQ ID NO: 2 - DNA, 5428 bp, Artificial Sequence
  Description of Artificial Sequence: Synthetic polynucleotide
catgcgggtgcacatctgtagtcccagctactcaggaggctggggatggaggatcgcttgagcccaggagttccaggctgcagtgagctatagttacatcattgcactccagcctgggcaaaagagtgagactttgtctcaaaaaacaaaaatcttacaattattgagttgttataggaactattctaaatacatagcttctcatttaagcatcacgatggtgtcctatgagatagctactattgtcatctttcttaatgaggaagttgagacacagaaaggctaagcaatagttggtaagttacagggtttaaagtaggactcaagccctggttgaactgaatccaaagagtgagctctttctattcaaataggctgctgttttcattaaggcagtgagcaataagagctagtaagtattgtgctttcttcagcaaaattaagtatttgttttgaaggcagaggaaaaacatgctcttcaatttttacagttacatgaatgattgtatgttttgagatgttgcactacagtttcctaaaaagtcctcttactctcgtagaactgctctacatttggcctgtgccagtgaccatgtgaaagtggtcactctcctggttagcagaaaatgccagattgatatctgtgacaaagaaaatagaacgcctttgatacaggtatattagagccaactcttttagcatgacatggatttgatttgcatacataaaattaaaataaattgatctcatttaaatataactagttggtgaaacctgtggaatgtgtattttgaatttcttagactttacaatctatttattggtctaatacggacaggctgtccattgccaggaagaggcttgtgccgttattctgctggaacatggcaccaatccaaaccttaaggatatctatggcaacactgctctccattatgctgtgtatagtgagaacacctcactggcagaaaaactgcttttccatggtgcaaatattgaagcactggacagggtatagatcaatcaactttctttccaaaatatttgttttaacattgacataggtaagggtcatttttttatatttggaagctcaaccattccctgaatgcaaatgcaaatttttttgaaataattgtctaagattttattttaaatattcataattttaaaggagcattaaagggtacagctttataaaacgcactttggaaaatatttctgaatttgttaaaggtaaaaacttttcaacttcttttctacgcagggttattctttccttttttcccccctaattagtgtaaaacatcacaggaaagaacatatgccctggaagtaggctttgtcttaaaactcagacaaaactaaagcaacttacaagaagtggacatgttgctgctgctgataattttctgaaaaactgatgtatcatctctcagtggcacaaggcttgagagggaaaaatgagaagggaaaaggagagcaatcagaaatatgcaggtcacttggaaattaggtaatgagggaaaatgccaagaagagttttttttttttctcttagtttgttgttcttccagtttatgtgttgagacaaggcgttccttagctttgggtctaataatttttggtttgaaaatgacagtgagttgaaacttgcctagagattaattttaggaagactttgaggaaaccagattagcagggaatatgtggtgatgaagtgggaaacacttcaacagaaggtggaacaaattattaactgacttattgcccatcctggcagaaacagccacttagataagagtctaaagcctcctctcaaacctagaatgtcttggtggaaggtaggagataaggagcttataaataggaaaatcaagtgggattttgagtttacttgtctgtgttctacccatacccagaaaacttaactggagctttgataaatgacactatctcttactcttttctctttttggccacatgtccaactgataaagggaattagccatggggacgagagatgagactgaagtgattgctgcactaattctcagaattgtgcattacagtgacctgaggacattttgttaaaaatctacaattgtaggctttcccctgaggattttgatataatagatctaataaggcctgaacatttttaacaatgttttcttgaagctgggcacagtgacatgttcctgtagtcccagcttgagcctgagtttaagttcagcttgagcaccatagtgagactcttgcctctaacaacaataacagaaaaaaaaaaaaaaactcaagttttggatacactcctgattaagaaccccagaatagatacgtgcaacatataaatttctgtatctcaaaaatgtaagaaatctctagaagaattggtgtttgataggtgctacttccttcaaagttctccttttcagtaatattagcctgacatctgtttttctctacatctgtgactgggaagtgaaaagaaatattactggtaatatctctcagcttacagaataacaccttttccttcccaccgttaatccttcacaaacattcagggagtctttagcaatttgcttatgggtaatctttcaataagtagaggctgaccctttcatgatttcatgtccctttgtcaccatgcacgtgattatgtgtcaacaaatgttcattacaagttgggttttctcaattagaatagtagcaaatcctaaacttttgttttagttgaagttgtattatgaactagctcagtatgtttgttaagtttatagaactttagcatacccaaaatgtcagttttaaacactgaagtccatggagttaataaaaatacagatatgaattcttttaataatttagttttagcagtcctatgaaccagttatctatttggttaacaatcttggaaaattatataaaaatatattttaaatgaataaatgttggaaaaattcttgaagcaggtattatgagtcttttttggcaatttttattatatatgagagcctgattttttggtaaaacctatgatactagagaaagaaaatattttacatgcaaatacttggattatacacaaccatttagtaacacattagaagcgaatataaaaacacaagggctattttctaatgtggcacacagatttgtttgtttgcctctataagttgaatcagcatgtaaaatttagaagactggtgtagaaatctggacttcaggcttattctaaaaaatcaaatctggcatctctgagtttctatcactgtttgatctgctgtgcagaggttacccctttagagaaggtatgtattctccagtttggtactgtgcccaccttagtacttcctttactcaggcaaccctgctttgtccttgtaagtatctgagtttacaactcctatgttatagtatattttgataaagatttcaaggtttttaagtcagcgtgtatttgttataatatatagtctatagagtatataaatccctcagttatggagttgaattttagaatttagaagttttgaaactcttttctttatatataccacaaataattatctgtccataagaatgcctagaagcctttttaggttattcctggttatagttggataatttatgaatattgcagacattacatctttctcctcagtgctcttccttagaaatgcaagtgacttactggcttttattatgccagaaataattcatatggatcagtatgagaacttttattgataagacattatgtttttatttctgatttatattttgtctaaaataaaaaataattttaagtagccctttaagtggaagccaataaaaatggatttaaaaagtagagctgccctgaggtcctgggattaccattataattgagaatggtatttcttactgagctttggttttttaaatatttgttcttaagttttttaaacctatttctcttacacagaacatactgagctttctaacagtaaagataaaaatctgttctctcgtattagggaaaaaacccatggactatttaataataaggaaaataagtgcattggaagccaatctctcttaattcagagctcatttccatagtgacccatttggagcaggagtgcctgacattggcatctgcgatcctgacagcattgatagaagtgaatcaagcaagtttgtaccactcataagaaacctccacctgcattgggaagctctggcaactgtacccctaaaacaattcctcaaatgttaatgtttgccacaaatagtattgtcaaatggggattaggtaaacttcaatagatttcttgattattggacataacatacagttttataatatttctcaaatgcagattgtcatggagtctttctcttggggtataatacttctggtaaagcaaatattctttggaatatagtttaagaaacactgctttagtgagaataatttagatcattaatttctgtaaaaaacttaaaatgtttgctactatgtcttcgggttttggggctatagagacaaaagatacagcccttgcctcaagaagctcttggtttcagtgggaaacagtgaaatgattacaatgtaccatgctaagtgctgtgaacaaagcaaggattcttgggactggtaaacttttaaagtgagttttggcaatgaccacagttaatctggggagacagaggagggttgttgcaaggcaaagcccagcacatcagaaagcacagaggagtgagaaggaaggggctgcttttcatttacttcctttctatattgtatgttgaagttcaaaacatcccagagaagattttcatttcagttgagaaatatgtaattttgtgaattattaattttttttgtgctgtttcataggacaataatactccacttttattcaccataatttgcaagaaagagaaaatggtggaatttttattgaaacccaaagcaagtacacatgctgttgataggctgagatggtacagttgttcttttttaaaaaataaaacctgagtattctagagtggtaacagtcactcaagtcagaaatatcaataagaagattaacataattattggcatataatgaaaaatatcaccacgaataatcaggtagaccagcaaatatttggactgagtaacataaagaatagtatataggaggattcaccttctcttataatatagagtgtttggtatttatgatcagatgtttttggtactgtaatcttttatgagctaaagggttttgtattagttttattaatttttttttgagatggagtcttgctctgttgccaggctggagtgcagtggtgtgatcttggctcactgcatcctccacctcccaggttcaagcgattatcctgcctcagccttactagtagctgggactacaggtgcacgcca

SEQ ID NO: 3 - DNA, 4054 bp, Artificial Sequence
  Description of Artificial Sequence: Synthetic polynucleotide
aactaacctgcacattgtgcacatgtaccctaaaacttaaagtataataataaaaacaaaattaaaagaggactaaaaaaatattggtgttgaagaatacaataagtcagccaacaattttaacagaggacactgtcggagaggctcaggctttcctttcccccagagcaggtagccctgaaatttccctagacatgaatcactgtttcctcccgcccaccttccacattctccccagagatgccccggactccagagttcaggttctcacatgttgtgggactttaggttaaaacccacctaaaacactgagtggctcttgtccttgatcacttcatcatcgtccccattttagttgatgtgatttttttttttacttcagtttgaaggaaagaaagcaaatccatagactctacctaagccagttttacttctctctctttccgttggtagctgcgaatgtagccccaaatatgataggaatcagtagacactgcagctcttacaacactttctcagtcagctggtccaacagtgtgggcaccacagtgtgagcacaattattttatgggactaattgtgttcctactggagacacatttcctcttatgtactgggacctccagtccattgcagcctatgattacgaagaaggaaagaaacattcttcaaatttccaacatacatgtggtaagagaaactgatatttctgtccactggtttccagacccgtgccaggtagctcctggacactgggcactgtagcgctctctgttttcgggcatttaagtatcctggagaatagtattatcctgaaaatgaccttctttagagattaaatttcctactataaaacaatggcatgaaatacctgacgtatatctcacatcatactttggagactgaagtcaacccttccatttttctgctggggtctttgtttctgggcaaatgtgagggagaaagaactgctggatcgcagactcgtgttcccgtgatcacatctcctatcctttaactatagctacattccctcatgtcagaacacattgtgcaatgtctcattctaggaataagatattcagtaacttggacagtgactctagtagcttctctatgattaagaaaaatacatgtgaagataagagttaattcttctaagtataaatgactacctataaggtttgggctttgactaagtttttcaaattatctccatatgactggtgggtatccttacagcctgtaattattttgttagacaaatgtgatgtctatctctatcagctgaggcactcagggagaggtactggtcagtctggttggaggtatctgctcactctttattgtacatgttagggaatgctctgatataaagagagagaatgctatcacttgtgagcagtatcgattaaactgcagaagttcgttgtactatgaggtcaccataccctcttaggtggcagaatagatttcccttcctttcagctgctggttttcttatgttaaattttattgcatttacttttcctttacattgttgtttctaaattctaagctattgcctgcctatttaattaaactaaacaccagtaaatttaaaattaacaattacctgtacaagcatcttaacatgggtgtgttgaagatgctgagtagagataccagaaaacaaaactaataaagaaacatattgtgtaagtttagagtagtcagtgagcaccgaaaccatgaggagcttgtgttgacttttatatgaaaaaaagttaattatatttgacatccagaaggctggtcacaccagtgagaaaaatctggagggtggtccacacagatcagaaattagaaagtgatagtcacaaacttgcagaaccagcagacatacagtgtattcagcattcagctctttctatttcttcaggaaaatagatgtgttatatctgtatggaaaatgcgacaagtagttttaagccgattctcctgggaagttgctagtgaaatcactcaagtgctgctctgacacaggattgtgaagaggacgttgacccttggtggtcactgtcagcaacacgggtgctcaaccatggtgggtgcctttgttactgttttgtccacaagagattttagcctgtcatgtgctgcatgcaggtgagtttttaaacctcagatgaggaaaataacatgaccacagagaagatgaggaaattgaagacctcacttcatcaaccaccttccactgatgaaaactttttacacagagagccagggatgagctgggaagaggaaggggctggggaagatcatccatagcaggacacatccagcctgcttgaactccctgtggaaggagggtttaaatgtttgtcctcagctaatcaggggcatttcaagaccttcataagctttcagaaaaaacagttttcatgaacaaatgcccatatgttactcagagatgtatttgtcatcatttatccttcctctctaggcagtaccacagtagcatgttctcagaattctcccttatcctctgtgagttcctgatgcagctcctggaggaaaagcctgcatgggagagggagccctcctcaagtgcagccctgaggctgtcccatcacctcacccgccactgcccttcagtcactttgtaaacatttctgagctaatcttcctgaaagtgtggttttgggcactatattcagcaggtaagaaaatccttaagctctgtttatttctacaggcatgtatctctttctggagcacaggttgattctgactgtgtggtagacgataattcatgacaggaggtttctatgcatctcgtcaactcccagagtgcaccctccacggggttgacacgcacatgccagcagatggaatttctcagctggaggatgacattttcataacctatgacctcagtggtgctctttccttgtaagaccaatcatgatcatgcccctggctaatgtgcagtcattaagggtgagacgtgcccttgtgagggtttcttccaggtgcccacacactttgtaaagggaagcttttgctccttcctgtgtcccgtgcatgtgtttgcatttactgcacagaccacctttttcagaaccaccacccaagagctcacagtgcatctaatccaactctagggcattatacatggagtctctcattgccagggtctccaattcccatgaaaggatgttcattatgggattccccagaacttgctggccttttagagacatgaacctgcctctaaaatcttaaaaatcttactctctgggaaggatctttgtaaaccagaagtaagataagctttaaattaatatatgttttgtggattttggaagaatgagttcaaatagtaagagcctcaccaactttccctctaactaatatgattcctagaaatccactgaacaaaacttgtggtattccgagataaattaggcttgttatattagggcatcaccaaaaaagaaagaatcaaatgtccttggagattcctccattgtaactgatttgtgactgtggtgctggatggtcatagtggaggaggctctgcctgtgtagggcagggagtcatgggaattctcatgccttctgtgcaatttcattgtaatcctaaaactgctctaaaattaattttatgataaagagtggcagaaacatttgaaagaattttttccactttttaagaatcatactgtctcacctcatgatcaaataacattgctccaaattatttattcatctaatttgaaaacttgttcacagtagcaccttcctggaatgtttttatcaactttattgagtgtggcctttcccactgtgaattcggcttctacaattcttgaattgaatatatctcttaaaattagagtgtgtacttgtttctattgttatttttttctcaaatatataacccattttcaaaaaagccttaaacctgataacccctgtcatctcctcagcccagcacagctgccttctcccctagggtttctgactctctgaggatgtggtttttcacactgtgcctctcgcacagtaa

SEQ ID NO: 4 - DNA, 3992 bp, Artificial Sequence
  Description of Artificial Sequence: Synthetic polynucleotide
gtctgcctgctaagcaacctcttggggagacacgggcactcctgagttatcgaacttgagctgtttggtgttggcatgttaatttatcttcttacaccacttaccacttccttaacatcaaaagataagaataattattattttccatggttgatgtgaagagtacaaataacttatacaaaatgcattgcagttaggaggtaataaatggcagtgaatgcccttattaatgttattctatcagtctcagctcagataccatctgctctgtgagctctgctctgaatcatatctgcttcttctctgggttccttgtgctctgttcttaactactttaaagcagtaattgttctgattctaattagtgatccttcccaataaaattttaattttgtagatctcttccccccaccccagcccccgcctaaacagaggtttcttacttttttgtgtacaggctacatcactggtcttcttttatttgtggctaaataaatgttgtgttagaagagtaaagagttcccagttacatgggatctatagttctacaaaatgaatgtatacataatccatgtaaatccttcacttattttaaaacaactttttaatttttaaattaaatttaatttgtgcatgtgtgtgagaccagagtgagaacagagatggcggcggtgaggggcagtggtctcaccatgttgcccaggcaagtcttgaactccccttcaagtgccaccctcctcacctggcctccctcaccttgcctcctcccctctcactcctatgccagctcctgccattccccaccccctctgtagactgcaagactcaacaagtgacttgctgagcaaactctgctaagagatctgtttagggacacaggaggccaagtacacaaaaaagcaaaagaactagcatgcctttttcaatggatgtctattttacagggctggcttcagattattgttatagctttaaataaaaggaccgttttgtcatctcggcccatggcctacattatttctttactgtccattgccctgggctcttgactaataatttaacagcaatttttttttaaattttaaatcatgattcattgcattgctgtaagagtaattagaggtaaagtagggctggaaactgcctgtagttggttacttactgagatcttagcatcattgtcaggtgagagggtgaagttttaattagcgctaagtgggatagaaattcaatgcactgaaactgcagtgtccaattcagtaggtgctagccacctgtaactgttgagcacttggaatcctggctagtcctaattgagatgtgttgtgttaaatacactggattttgtcgttggagtgggaagaacagtgcagaatatctgcttgactttttttatatttattacatgttaaaattattactatgattactatttgggacatactgagttaggtatatttaaaattaatttcaccttttcttttaatggggcttactagtacatttaaaattacatacgtggctcacatatttattggacagcacagctctagaagtttaggaagaaataagaaaaatattgagaataggtagcgacagtaggaagtttgacctcctgtaagactgattccaataaaactaataggtgatagttttaattggctttttcctactagaagaagtaagtgtactttacatgcctctttgttctccctctttccccttcaatttagtggttagcgtgtatttactacatcaggcttaatattcactaaacagtgttaagaagacttaggtaaatgattccctgatgaacacacttgatattcaaagcactttcctaacccatttttaattggaatagagtcaaaggtagatggcttattagtagtcatctcatttaaacctcgtggaattttcctgctaaatctcaaagtaaacaatttgttataggctgttttgtcaagtgcatggaagggacagcataagacatgtggtacttcgtttcaaaattgcttgagatggttttcattataatcatacattatttgcttctggttttccagaaaagccagctaaacctgtggttcatttagatataaatgaaatatcctcaaaggattgctcaaagtgacttatgcaacttgaatatatatttttttctgtagggtgtttattccaaattatctggccatttgtggcaatttgcagttttttagaaaacaccaaatatttttcaagttagagatgttttaataaaaacagtcatattgaactggaagcagccaaataaaatggtcctttatttcacagttgagaatttgaaattggaaggtaattaacatatgtaaggatgatgtatttgctgcctggcttataggaatgagccaaggtgttttttgagggatgttgttgctgtgtatgtcccacctattttgcttccttaatgaacaatgcaagtttgagacagaaatatttgagaacatttttatcagttgcgacattttgatagtgaacattttatatcttctgtcaacttaaaatgtttgcatcttctgtctgcttaaaatgtttaatttgttatagccaaataatttggctataattgataatttaatttatcaaattaaattgcttttttccctttagactttcttcagtcacatctgaataaatcccttagaagtaagctagatgtaatataatgaaatgcttaaaagggctgtgtatcttcatattacacttacaatgattttctcttgtgcccattatattctacctgcagctagttgaggtaaagagagggcatttaactgtcaagggaacctgtgaggagactgtagaaatctggaaagtctcttgggtctttgagggattttgggatgcagagagtggggctgggatctctggctaggttggagccagcgtgcatttgtatctttatcttggaagcaaacttagaatgcagagatagatgtggcctggatgctgctaactctagccaaccactaaatcttaaggtgggagagatggagcctttggctgggtgctaagctgctgtagctggttgaatgtagaggtcactatcttttctgaatatttgtaagtaaattaaatcattctttactcctgtatgcctgccaaccaaatgggaaatcgctatagaaaagatggtttaaattttagtctttgaagtggtttatgcacgtttctggaatcaagatttaacgcggacttggattggatattgaatatttttgatttgtctacttttctctccatagggagcttatagcttcattgcactgtgtgtggcatttgggtcctgtttgacagcaatgactgcctttctgtttagtgtctgtgtgctatgaagattgcacacaggggtccagatgcatcctgttttgagaatgttaatggatacaccagctgctgctttggatttcacccattggtggtagttgacccgctgtttggaatgcagacaatttaagtgaagacatatccatatatgtggctctgttacaatggtgaaatctacaaccataagaaggtaggggaaaagaagccagatgtgtggatgtgattaaacttcagagcttgttggttacgatgacattatatattctgtatcttgctttttactttgcaaagcattctatgttatctcatttgctctaagtatgtagatagggaactgatgaataaaatggtgagttaaatcacttggtcacaaaaaagtgataaaaatggggattacacagtttctttgactcttagaattttttctccttctccccagctttttgttttgaaaaaaattctaacatacagaaaagaacagaatagtgagcacctagattgaataatcattaatgttttgccatatttgcttgatttttctttctacacacacacacacacagttttttgccaaatcatttgagagtatggtgcagattttgtgacactcctaaatatataagcat

SEQ ID NO: 5 - DNA, 3945 bp, Artificial Sequence
  Description of Artificial Sequence: Synthetic polynucleotide
gcgctctgtgtgcagccccctcagccagttggatggtgcttacacaaaaagtaaacattgtaataattcactttcgtggaatcaaatttgcaaaacatgcatgaaacaaattagagcggatcttccctacctagtctgctcagactcacacactgatctcctctggaaacactctcacagacacacccaaaataatacttcaccaggtttcttggtattccttaatctagtcaagttgacccagacaattaagtccacaagttcactccttgtcaacttggcacccatacatgtctccttaaatcatacttaatttccaaataaagacaataacaaggtaatattattgtcccacctaacattatgcaactaacatgatgcaactatcctgtgtgcaactgaaaatgcactaatgccttccatagaatttggctttcaggatttcaatatttgtgattttaatcttccgagatggtgattttctggattttagatgttatagatttcagatttaaggaatttaatcttttgggatttcaacattcaggattacagagtttggtattatgtctttttttattatcagcactgggtcaaatggcatagctgggatctatgttcccctgtaactggttccaatcccattttccaacttagttttttatcatttggttagtagtcataaggtactttaaaaaaggtctgatgcaccttggaaccttcagggagggactatattatggacaaatggaagttaacaaaagagtaataaagttcacagaagataaactctatcacaaaactctacctggagcaggtttttccattagcattcaatgcatccaaaccaatatttcagacttcatgccagcccagccactaatttaccttacaactaaggttattataaagatctaggagaaatggcaccatctttatttttgtatctcaacttagcattacgaattttatctttccttaaacaaaactgtgaagtgctgatcattgtaccctaaagaagatatgcagttggagaagatccaggcaacttaccaaagggattgggcattttctacatgaaaacagaagaataaggctgaaacattttaatcaggaagtgtttggattgtaatgttcaaccttgtgatgggtacagaagtataaatatagaattaattattgaaaaatcagaatgcagaaattgagtatcttcttgagtcaagaaagaggtaattttagagcaaatagatggagttattaaggaatagtacccattaaccctggggaggatagaagcaaaaaccataaataattctagagggatttagataaattcagtggtgataaagacagtattgttttattaaggttattcatttgagggatctatcaatcttttgaatgtaaaccacagagagcaaaaatgccacatagcattttatttagttggggttatttatgtaagaaatattttttgaacacttactatacagcagactctgtgctgggcacttgtgatgaatatgataaccaaggtctctatctaatatacatgtgagacaacaattataatacaatgtagggctatgtaaggagaaataaaggataataaggaagtacacgagagggtcttattacctacctctgcatcctcagggattttccttaaaactgcatctgtgtagactgcaacaatgtttacctacattgtttgctgctgtgggaagtttaagaagcagaaaggaataatgaaatctggcagatcaattccaagatggcctccggtgatttctgcctcttggtatttatcctcgtgtgcagcgtcttcctcttgtgtgtgcacagggtctataacctgcttctagccaataaaatatttcaaagatgatgggatgtcatttttgtgaatcagttacataagattctgacctcgggcttgctatcaaactctatcccttgttagttctgataaaacaagccaccatgttgcacgctgcattatggaggggctcacatgacaagatataaagggcttcctctgactagcagccatcaagaaactaaggtcctcagtgcatcaacccaaaaggaattctgccaacaactacatcatcttacaagtagatccttccccgggtgagttttgagataagacgtctagattttagcattgtgagagatcctgtagcagggaactcagctaaaccatacccaattattacatacacagtaagtgtaaagtaggagtctgtgttgttttaaggcactaagtttgtgtcagtttgttatatggcgatagataattaatataatgaggatgccaaaacatccccatgaaacacactgcagtcagtcttttgtgctaccataggttggataatattttcagtattttagatgagacatagttgtgaccaaaatggtggtgatgtgatcaaaagatgaagatgtgtttgagagatatttaagaagtaggattggcaagacacattattaatttgttgtggaagttgagggaagggagaaatctaagataaaactcagatttggcatcagtcactgagaagattatgatgtcattcattaagacagagagacaagaggtaggcagtggagaacaatgatgagtccgaattgcatgtgaaacattggagtgaagatatccaataagcaattggatatgcccatgcatctgaagtccaggagaaaataaactgagatgaatgaaagagcatgctgtgtattaaaaccatgcaaatagatgtgattttaatagtgaggaaagtaaaggtgaagagcatgaagatcctatggtaagttctgaagaatgtcaatctttaagggataaacagaagagaaggaggcttctaaaaagaccgagacaaacagataaaaaggcagaaagaaaagtagcaaaatgcagtttcatggaagacacttatcccccacaaaagtgtttcaggaagaaggaattggtaaacaatgtaaaataaaaagttaaagaagatgtagccttcagaaagtggtaatttttgagagaaatttctgtttttatagatggttatgttggaattcacattgcttgaggtggaaggggaaaggaacataaaaatgaagaaagttgggatagacaactttgtgaaagtttagctctaaaagggaggagagagatgctgatagccaaaaaggattataattattaaagactcttttttaagacagtaaatttaggattatgtttaaatgctgatgataaatagccattagaaattgagaaattgaaaatttaggagaatcataatacaccaaatttccagaagaaaaagcagaggatgtaatccagagaaaagtggagaactttgatttggacagtgtcagactcaatcctagacccaccatgattatacattgcaaaatagaaaaactattattttacacatcacttagccactttcagatctatgtttcttatattggactttcccaactgatctatgagataggtaaagcattcatagtgatccttacatttaccgatgttaaaattgattctccaaaaggttaagtgactggggaatttagtaactggagcttgaataatttattttctcttccatgatttttttttcactacatcctatcccatgccagggaactgacacagtatggtactgtctatacagatcattctgagaactagtaaaagtactgtatgaattgggacaatctgacaatttaaaatgcaacctaatataattaaaactgttaaggtggtttcatctctagactgcagatagttatctttcttttttgtcttagggtctttatttatttatttatttgagacagagtctcactgtgttgccgaggctggagtgcagtggcactgtgttggctcactgcaacctccgtctcctggattcaagcatgcgctctgtgtgcagc

SEQ ID NO: 6 - DNA, 3782 bp, Artificial Sequence
  Description of Artificial Sequence: Synthetic polynucleotide
gagaatagatataatctctcaagatacttaatttccatgtacccatgcatgctcttatattttcaatgtataactatattctctaaaattacatttagattttagggcgataagaatggtaaatcagaaagcaacaaagtaacctgaagaaaaactaggcttataagttttatattgtctttttttaaaaagtaaacaagatacccaattgagggaatatagaggtgtgcaaatgttgtaaactttagtgcaatatagacctgggtttgaatctcacatttgtcattcacacccacaggtagtacactggcaagtctgaatattaccttgtcttaccatttccacacggataaccctagtccaagataacatcagcaaccaactggactcttgcaatagtcctctgccattcccaccactctctattcacattttctccttcaaggaacttttccatgcagcagccaaaaaaatttaaagcataaaacttattacttaaaactctccacttgctttccattgtaattagaataaattccacatttattgtatcttttcctccttgttatatatgtatttcagttaatgacagtccctggaatatgctaagctcattcttgcattaggatttttgcacagatattgtaatatctgtgagcaagaaagagatgaaggaaagggctcaacttacgccctcttcaggtaatggcatatttaatattttgcaaatctgttacctcatctgtaaagcttatcttttattatttccggagatcatgggaaagtcatcagaagtgtccagaaattatcctgggtatagaagctgagagaatggtgctattaattctaggcatttaaagattattaaattaaaaaattgctaatcaaaggtgggatcattgaattatccactgacatcaatattataaccatttttgaccatatacagtatgctaggcactgtattaaacactacagaagatataagaatgaatgaatataaaagtctttgcttatcatctgcttatcatttggaagacagaataagaacaacacaataacactactactaagcagaatatgtaccataaaataatcagaatgtaaagggtaaaggtttttaaaatggagggtttaataggtctgacttccacagtaagcaacagcagtttaaaaatatgcacatctgttcccaatccattagacttgcttctccttaattgaattgaaatataagattagttggttttggggatcagggaattgaggaaggcttaatgaaggaactagacctagaaaatacagcatttgagctggaccttgaaagtgggaaaaataatggaatgcacctttatttatctctttcttaatttagccatggttttactaagtaaataagatgagttttatgattttgcagaagtatgcctgctgaacattattgacctcatgacaatcttccaatatgtttttaaggaaaatagaactttatttttggagagaacgaccttgggcaactaaattaacctctttctcacctataaaattctaatttgtagaactgttgcaaagattaaaggaaataatgcaaggtgtctggtgtataggcacctgattaaagctagctctcacttttacttcttaataactgaagaagttgtatattactgaaagtaagcagaattgtggaatagttaaaactctacactctgaaatcaggctgtggtgatcagatggccttcgaattctgggtctgacacctcttgctttgtgatcttgggcaggtaacttaacatcactttgccttacttccttcatttgtcaaatggaaattataatatatcctaactaagagggctgttgtgaagattacatctgataattcatattaagtggttaacatatagtaggtgctcaataaataattatttataattacagtaataatcattaataattatataagtagaattgaaagctaacactaataatatccttaagtcataggggttattgtcagtctaataatctatagcatgtgacaggccaacacatgcccggtcaatgaatatattattctaaaaataaactcatctaatcacatatacagacctgaagtgctatttgaagtacttcacttgatgttcttgttgtatttgatcatgtttccagtgtttgcttttgactttactcatatttttataattcactatttatctctgatttttaaaagtggtgagggaagtcagttccaggcggtgatggaagccaaggcctctgatctcaaaacagctatggaagatgaaccaaaaggaaaaaacaccgtattagaagagaatgccttcaggggtcctggagaattaaggctagaattttgctattttgagtcaggcaggaaaaaaagaggtgcagattgagaagtagaaaaattattgcttgggagaggaatttcctgcttgactatttcctcttaaatctcattatgtaagtttactgattgctttttctaaactcaaatttaggtcccaagtataaaagagaaattctattaaaatatgtatagattatacacctttggagtaaagtggtttctttctacatgtttataattatgttctggcttatgcagaatagtctatagttcgaacattctggaactgagatttatattccctaaatatgcatgaataagtatctggcccacctcaataagaaatgaggtttgttgatttgatttcccttagccagcttgataagcagaaagactgtcactggaagaattctggaagaagatattaaagctactgcacatatctaaatgtaacatatcaaggatctgcctgtttgctcaagaaagggaagaaattcattgcttaacctcagtgacccaaataggctttctgcttatcttatacatcccaagttacctcccagtaacttgaacatatcttcttttcaagccttccaaattccacccaaattgaaagacagtgttcttggtagatgtcttattttcgaggatcgttggcttttcacactcagtaatcaccaccacaggtacctttccctcatccacacactcaaatattacctatcatttaatctaacctcaattcaaatgcaacttgttcttcgaaaccttttctaacattttcattttaaaaaatcccttcctttaaagacagcctcctgggtcttcatcagtaattctaatatggcaatatgcaataaatatttattgtgtacctaaaatgtgccacaagctcagtgctagggatatgtcagtgggtaaaacagtcagaactccttgtaaagtgaataaagttaaaattgcttgttagatagtggtaaatggtaaggagaaaagtgtagaagaggaagagaaaaggaaattggaaggtagaaattttatgtggttagtggaggcctgtcagggaaggagactcaaatctgcaggaaatggggaatgacagacaaatatctgaaagaagaacattcagacagatggaagagaaaatgaaaagactctgggtgaaagtgtaaataggaggaaaattaagagaaatcatacaggtgaagagtggggagtgggaggaggaggagcaggcagattgtacatgtttttcatggccgactttttctctgggttaaaagtaaaccactgaaggctttgattaccacagaggcatggtctaactcatattttagtaacagaggcaacaatgcagcagtgagaggataaaagttctggaaatattctgaaggcgcgctctgtgtgcagc

SEQ ID NO: 7 - DNA, 3383 bp, Artificial Sequence
  Description of Artificial Sequence: Synthetic polynucleotide
aaactatatcacaaaatctccttacctcatctttttatctacctctacctctttccatgtattttttgacatatctctcaaattacatgtgaattctgtctgggctaccctccatattggtcccaggttatatatctaaaatcttccattctccatgaactactgaaattaagatattctggtaaatacgtattcccacaaagattcactgcacagagtttaaattatatgtgtgattcttctatcaacagcttcactaacttacagagttaaaactgtcaattttgccttcaaaacatctcttgaatctattcatttatttccatttttatcaccctttatctttaggctcacattatctctgcaatggatacttcaattgctccttaaatggtctccaaacaccactctgacgcaactccaaactgttctccatactatatccaaggcaaagattttgaaatgtaagtatgataattgttatattctgtctaaaatattttgttgggttctccttgctggtataataacttgaccaagaggctttcacataatttatccctaagttatctccaaagtcttattgcccttgtgcctcctcgttctctctcagtcaagatacaccagtcttctttcagtcttttctactttttttctccctccatctgtgtgttgatctccctttctgaaatattattccttgttctttttgcgttgatgattcagactctgaatttcattcattcgagtatcacttcctagggacacttaccctggcaagtggaaatgtttccatttttaactgtcacaatagctacatctcttgtgtagcacttacatttattatgtcatatttttaagagatctgttttctctaacagactgtaagccccatgaagacatcagtagtgtcttttgaacatttgaaagtacccagtgcccaggtgaatatatagcttagagtagaaattatttgattgccaaaaagtattaatattccttgatgacacaccaattccaatctcatgaaagtgacgctaattatgtggctcttgcttcagaatatttggaaggtcctctctaattctgtatagtacaagtttttgagttttgacatttcacaagttatctccgaagcctttgaaataacaggaaaaaaattcaagacttccaatacaggggatttctcccagaagtagcttcttttagaggctcttacccaaagtttcagagctgtttattgtactagacagtggtctaaatgtacaattaccattatctaccatactcagtgtatagaaaatgtacagttcaagttacatcacaccaagcatccctacactttgaataaagtaggagataaacctgcctataccaactattaaatctattctcttcattctctgatcacatgcttaaataaatatccagtaccaaaaacaataatgacaacaagaatcaacaatcttcagactctggacaaaaagtatcttaattcagacttgtggaaagtaaataaaacacatttctccacttttccaggtcacaattttggaaaaataaatatataaccaatgtgtactttaataacaaaactacatggaatctgaatgtggctccataagactttcaggacttccaatgaataagcatttgacttgtatttatatattaagaaataatgagagaatctgtttctcacagactcagtcttaaaaaggcatgaatcctcaaggttgtgcacttaaatgacccggagaatgaatgcctcattaaattttgcactctagatgattgccttgcttcacactagtgctgatgctgcctgaatggcatcatcgaatggtattttgaggagtttataaaagctaattgatagaattagtacacataggaatatttacgtttgaaattattcttgaagatataattttactatgtttgatggtgaaagtcaatgtgaacaagccttttaaagatagatagttttaaaagtcaatagaatgatttctgcttccaatacagatagtgtaacaatgattcaatctactctactacctgaaacaattaaaaacttaaaaaaaatacatgaggcaaaagttttaagacataaagcatcaggcaagaaaggatagtgatcgctgaaaagtgaaaaacaaatgaaatatgagttattattgtttcttataattgctgggagagtttttctgagcaatgccatgaaagtgtaaagccaggtagaatgaggaagacccactaagttgagaagaaaaagctgacagtccacagagaacatgacattagagtttacaggacagtactggagatgagagatatgcagagagaaagtgtctgttcctactagggaaacgtagatccatgggacattgggtagagcatccaagagtgccttatcttggaagtggtacagtgatcaactattgtattgtgagtggaagagtttcagggatatgagatgtttaatactaaaaacaggacagtcacagacaaaccgggacaattggtcactacagttgtgagggaataatttgcccccaactaatgataatatcttattgcttaatacattttaaacacaaccccaaatggttacactgtttcaaaattactgtgtcacaaatcaaatctcaataataaatatatatggaaatcctatatctgacaacataaaatttataaaattagtaattggaagcaataataactgattgtccccaaataattgtccccaaaacaatgtttgttagataccaaactgtaggttgagaatgctcagagaacactgagcaggataaaaacaaaccaacaaaaacagaaacaacgacaacagcaaaagtaagactacacctaggcatatcatatgcaaagcacagaaaatctaaagtaaataattcttgaaagaagaaagaggaaacaaagcattaggtacagggagtcaacagtgagaataacatctgacttctgctaatcatgtaagcaagaagagaagagagcaaaatatttcaaatgttgagagacaaaaacaaacaacaaaaaaatccacctagaattctgtattctgtggaattatccttcaaaagttaaggagagatgaaatctttctgagacaaacattgagggaatttgttatgagtagacttatcttgcaagaaaattttaaaaagttcttcagggataagaataatagggaagaaatatttctacataaagagaggaagagaattagagaaggaataagtgaaggtaaaataaaaacattttttactcttaattgagcaagcagataacaatttgttaaaatagtaatattcagttatgtattcacttatgtatgcttatgtatgtggcgctctgtgtgcagc

SEQ ID NO: 8 - DNA, 3310 bp, Artificial Sequence
  Description of Artificial Sequence: Synthetic polynucleotide
gctgcacacagagcgccgtgcaggtttatgtgggggagaggctgtcgctgcgcttctgggcccgcggcgggcgtggggctgcccgggccggtcgaccagcgcgccgtagctcccgaggcccgagccgcgacccgcggggacccgccgcgcgtggcgcgggaggcgggggacgcccttcccggcccggtcgcgggtccgcgctcatcctggccgtctgaggcggcggccgaattcgtttccgagtccccgtggggagccggggaccgtcccgcccccgtcccccgggtgccggggagcggtccccgggccgggccgcggtccctctgccgcgatcctttctggcgagtccccgtgcggagtcggagagcgctccctgagcgcgcgtgcggcccgagaggtcgcgcctggccggccttcggtccctcgtgtgtcccggtcgtaggaggggccggccgaaaatgcttccggctcccgctctggagacacgggccggccccctgcgtgtggcacgggcggccgggagggcgtccccggcccggcgctgctcccgcgtgtgtcctggggttgaccagagggccccgggcgctccgtgtgtggctgcgatggtggcgtttttggggacaggtgtccgtgtcgcgcgtcgcctgggccggcggcgtggtcggtgacgcgacctcccggccccgggggaggtatatctttcgctccgagtcggcattttgggccgccgggttattgctgacacgctgtcctctggcgacctgtcgctggagaggttgggcctccggatgcgcgcggggctctggcctaccggtgacccggctagccggccgcgctcctgcttgagccgcctgccggggcccgcgggcctgctgttctctcgcgcgtccgagcgtcccgactcccggtgccggcccgggtccgggtctctgacccacccgggggcggcggggaaggcggcgagggccaccgtgcccccgtgcgctctccgctgcgggcgcccggggcggccgcgacaaccccaccccgctggctccgtgccgtgcgtgtcaggcgttctcgtctccgcggggttgtccgccgccccttccccggagtggggggttggccggagccgatcggctcgctggccggccggccggcctccgctcccggggggctcttcgtgatcgatgtggtgacgtcgtgctctcccgggccgggtccgagccgcgacgggcgaggggcggacgttcgtggcgaacgggaccgtccttctcgctccgccccgcgggggtcccctcgtctctcctctccccgcccgccggcggtgcgtgtgggaaggcgtggggtgcggaccccggcccgacctcgccgtcccgcccgccgccttctgcgtcgcggggcgggccggcggggtcctctgacgcggcagacagccctcgctgtcgcctccagtggttgtcgacttgcgggcggcccccctccgcggcggtgggggtgccgtcccgccggcccgtcgtgctgccctctcgggggggtttgcgcgagcgtcggctccgcctgggcccttgcggtgctcctggagcgctccgggttgtccctcaggtgcccgaggccgaacggtggtgtgtcgttcccgcccccggcgccccctcctccggtcgccgccgcggtgtccgcgcgtgggtcctgagggagctcgtcggtgtggggttcgaggcggtttgagtgagacgagtcgagacgcgcccctcccacgcggggaagggcgcccgcctgctctcggtgagcgcacgtcccgtgctcccctctggcgggtgcgcgcgggccgtgtgagcgatcgcggtgggttcgggccggtgtgacgcgtgcgccggccggccgccgaggggctgccgttctgcctccgaccggtcgtgtgtgggttgacttcggaggcgctctgcctcggaaggaaggaggtgggtggacggggggccctggtggggttgcgcgcacgcgcgcaccggccgggcccccgccctgaacgcgaacgctcgaggtggccgcgcgcaggtgtttcctcgtaccgcagggccccctcccttccccaggcgtccctcggcgcctctgcgggcccgaggaggagcggctggcgggtggggggagtgtgacccaccctcggtgagaaaagccttctctagcgatctgagaggcgtgccttgggggtaccggatcccccgggccgccgcctctgtctctgcctccgttatggtagcgctgccgtagcgacccgctcgcagaggaccctcctccgcttccccctcgacggggttgggggggagaagcgagggttccgccggccaccgcggtggtggccgagtgcggctcgtcgtctacttgtggcccgcgcctcccccttccgagtcgggggaggatcccgccgggccgggcccggcgtcccagcgggttgggacgcggcggctggcgggcggtgggtgtgcgcgcccggcgctctgtccggcgcgtgaccccctccgccgcgagtcggctctccgcccgctcccgtgccgagtcgtgaccggtgccgacgaccgcgtttgcgtggcacggggtcgggcccgcctggccctgggaaagcgtcccacggtgggggcgcgccggtctcccggagcgggaccgggtcggaggatggacgagaatcacgagcgacggtggtggtggcgtgtcgggttcgtggctgcggtcgctccggggcccccggtggcggggccccggggctcgcgaggcggttctcggtgggggccgagggccgtccggcgtcccaggcggggcgccgcgggaccgccctcgtgtctgtggcggtgggatcccgcggccgtgttttcctggtggcccggccgtgcctgaggtttctccccgagccgccgcctctgcgggctcccgggtgcccttgccctcgcggtccccggccctcgcccgtctgtgccctcttccccgcccgccgcccgccgatcctcttcttccccccgagcggctcgccggcttcacgtccgttggtggccccgcctgggaccgaacccggcaccgcctcgtggggcgccgccgccggccactgatcggcccggcgtccgcgtcccccggcgcgcgccttggggaccgggtcggtggcgccccgcgtggggcccggtgggcttcccggagggttccgggggtcggcctgcggcgcgtgcgggggaggagacggttccgggggaccggccgcgactgcggcggcggtggtggggggagccgcggggatcgccgagggccggtcggccgccccgggtgccgcgcggtgccgccggcg

SEQ ID NO: 9 - DNA, 3278 bp, Artificial Sequence
  Description of Artificial Sequence: Synthetic polynucleotide
gcacagaaagacaaatcctgtatgatatcagtcatgtgcaatctaaaaaagctcatctcatagaagtagagagtagaatactggttaccagaggttggggtagggagagacaatgggagatggagagagattggttaaagggcacagggtcacagatacataagaataaattcatccttgaatacttaaccctctgccctacatctgtcactcctacatccatattcattgctaatcctggggctaactcttgattgctttcttctcactactaaccttaagaaaggaagtaaccaaaatccaatacatgagcaactgttcattccatctccaatatctttgttcattgtccactttatccacccagtcagggccaccatcaaacctcacttggatgtcagcaaaagctccctggctggtctcccctctccattattgctttaatctagtctccatactatacacagatttacattttttgaatatatatctaattgtccttccctttttaaaaatcttacaatggcatgacatctcaattcacgataaggaaattggttcttcacattccctgtgcactgtacacatcgcctgcaattgcccttcaacacagagagcaggcatttcattagctgaccttcccacacacattcttgcaaagaggaaaagttaagcagggtgtttggaggcgagctgccatcatccaccgcctttgtctggaaggaagcgcagggcctcacacgcgggatccatcggaagcccaagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttcgggaggatgggggtctcttctccgagaagccgggagcctgttgggcagccggcgcccggtctccccttctgctgcggaggatccctgctggcggtcgtggtgctgctcgcgctgccggtggcctggggtgaaacgctggggggcgtggggaggcgcccgggctgacgaggcacccagggccccgcagagaactcgcgtgccgcgctgggctgcgctgctctgcgcgcccgggtccaaaggcagcgcgatgggtgggctgagcgcgctacctggcagggcggcgggtctgggatccttctgcgcactggagaccctcgctgcctctaggtaagcgtggagttcccacgtgcaggggcttaagtcgtgacgagcgcagtggaaggcgcagatgctgagcgggtgccgcacgaaattccttgcctttgtgtattcacagcctcggctggctatagccgagcgtggcgtcgatcctagcgaaacgggacttggggatccgacaaacctgagttctggtcctagaaacttaactgtgaggcaagttagcacacctaagtctgtttgctcttctgtaaaatggggacactggtatctctgcattgtggagttgctgcctcagtggcataaagcctgtcgagtatctaacacagggcctgtccccgagtccatttctatcccccaaccgttacctctgcactttgctcccagtggtgtttagacaagcagtcctagggatgtcctgcatggaactgtcctcgtcccctaccccaagccaccaccgccatcatcatgatgcacttgattgacagcatactttaagacagatgcatgccaggcacttggggattagaagagcaagggaagccccagaacatgcaatgtaaccgctgcaggtagaagggacagtagatatgtttacaatttgcattttagtgatgtgtttagtacaaaataaagcctattataactactatggaaattttgaggccacatctcttcctttttttaacttcaagtaggtaaacatcttcagttagaacccttctattattagttttgggctccccagaagtcttcttggttgcctagactcactggcaacatctcacttgaagtgacagtcttggttgttttggtcctgtctcttcctgacaactcagggttcgtccttctctgccactagacgttttgcattcattatttgagtgttccttcttctctaaaagagtaaggggaaaagaaaaccaagttcccccaagagttgttattaatatttgatcttcttaggcaccagaaagtaacctgtctagtgaagagatatgataaaacttacaattttatttttaggagagaagcatgcccagtaagttaagcaatctgttgtcagtgcttactgaggttctcacaataacctccaaatgtgaaacagcctaaactaaactacctagaaattttgttgctggagtaatttcaattttaaaatgcttatggatgcttccggtgtgcacagtcctttggaatttaaaagaaatgtaagagaaagagctatgctcccaaggtgtatgcatatagaagtaggtggtggagttttatgaaatctactttttaggaagccagtgttctggtttttccagactctgctacttaccaactggggctgtggacccagcaacttaagtcacatcactgaccttcagtgtccacgtgtataaaatgagcatgactgacatcctgatttctgagagaggtattttgaaaatcaggtggggtagtgcatgtgacagcgttttgtaatctgaaaaccctcatgcatgtctgaaaaaccatgactaagcagtcgtgcaggactgcaggatcactgaaaagggagaaatctcaactcctatgatcaggaaagggtgagggaaaagagtatgactttactagcacttgaagagtgaatccagaaacaggttgcataggacagtttatgggaatatttatatataaaaaataacagaggaactaggattgttttgtcattagagggtactcctactacccatgaagtggtatggtgctatttgaaagagaacttagattagctgcaaatagatattgcaaacttagggcaactactgaaaaaagtgaaaaaaagaagtacaattgatatgccagtaaggaagagtgaattgcatcatataaaatgctcagttaaaacaataaacggggccaggcgcagtggctcacacctataatggcgctctgtgtgcagc

SEQ ID NO: 10 - DNA, 3266 bp, Artificial Sequence
  Description of Artificial Sequence: Synthetic polynucleotide
atattagttggtattgttctcaatagtcagggatgttcaaataatgttgcaggaagagatcagagttccgcttcccttttgctgtcagatctgtaccttgaggcttttttatatcctgtgcagcagttttggttagataccagaatgttccatgttctctttccactgagtagtgggaaccagcttgcagttggtgcctcaagtaatgtgtctctatattcatgaaaatctcctgggctacttgcagctcttcctcaagttttcaatatattttaaaattctacctcacaggaagccattcaataaaattctctgaatctgaagtaagtgagttggatttgacagagctaagcctcatccatgactcatgagtatccatgtatcaaacagggctttgtacttatttcaacagcacatattttaaattggatcaatacagagcagataagcatggttactgcctagggatggcacacaaattcagaaagcattccatattttgcatagacccaggaaggccatttgactatttgttgagtagctccgaggaagcagtgtgaggaaaaccaaaacaggtgacacgcaatattgaaactgtgattatcactgtgaaactattgatgtacagtgatctctgaaatgggaacagagctgagtaataaggggatgttacatgttgttagtacatgtcttggaaatgagaaaatgtcaacttgcatttccttcatggaactgaaaaacaatcaaggcagggttttttcttgtctgttagttggagaggaccatcgatatccagcagccaagcacaaatctgctggctcagagtttgaggaggtagagaaggagtggtagttttccaagccaggttttgacacctattagttttctgcccttggtgtgattgatgagctcagtgatgagctcattaaatttatatgtatataaatttagtaataagttatgaattaggtaaaatgccctgaattacaagccacaacgaatgcaagtaataaccaaaattagcacttaataacattttctgaaaactgcaacatttgaatattagaacttatagaaaaacacacaccgagcattatttgtgattccaaaatggtttcagcaagaaggttcaagaataaattatttcattgctttattatttctctgaacatttaaacatgtaatctcattacatcttccaaacaacctagtgaagtaaggtagcagaatccttattttttagaagaaaccatggagcctaagagaagcaacttgtctgaaaacaaaatacctacagagcgaagtattttggttacagagcgaggacttactctgagggcaggacaatttgcatgatatccagctaactagaggtaatttactcagctgtgcttcctccatttatgagtacttcactttcttttcttctttaattataagcttaataagcttgtaaggtttaaaaatttgaagtgtatgggacattaaaattctgatactaggtctgatactgcctaaaatgtttttggaatttaatatgtttggtaaatattttttatttcagtattaaaatagcaattttatttattactttggtatatgtagaattcaacaacaaattttggaacataaaaagaagatacttaaaaaggacaaacgaggtaagtcttctgagagtgaatttcttacttctcttggtggtcctactcttgataagaaaataagaagtaagacgtaagattaaggtagtgccagtcaaaaaagaccagtttaaaaatatgtataaattcaatgtgtatatatgtatatacatatgtaaattaattttttaaatataacttctttagtttgaaattcagatttatttaagaaggtagttatagctaatttataatctcaaacattatggtctaaaaacattcatttatttaattatgatccctaaaaccctacataatatttttgaataaataagaaaaaacatttttaagttaatatgttgtatgtttcctctatagtcacattataacaaattggacttgttatacaaatggatcttctatttcatttttatagtaaattgtttacatttactaaacaaataactacagttgacccatgaataatgtgagggtaacaatcctgtgaggttgacaatccgagtataacttttgattacttcaccttagctagtaatagcccaccattgactggaagccttcctgataacataaacagttgatgaacacctattttatttgtgctgcattatgatgtactgtgttagtacaataaaataagctagagaaatgaagctgttagaaaggaaatcatcaggaaaaacatattgacttttcataaagcattagtagttcctggcaaaggtctttatgatcttcaggttgattaggctgaggaggaagaggagaggtggatcttgctgtctctgcattgcagaggcagaagaaaatctgcatataagtgaatccctgcagttgaaacccttgctgttcaagggtgaactgtattacatattgatttgtgtcactaagaaagtaactatctttagaaccaggaactcagcaatccctttctggtaccataaataaatggcaataagaactgtagaactgaaccagcgggcacccatacaaataggagattattttttttaagatagctactgagcacagaagatggaaaagcaattcctctgtgagaagcacaagttatattacatattcttacacaagcaaaatgatttcatctgtcatagtttacatgcatacacatacacacacgcacatgtgcacacacgtgtgcacacagacacaaagttaaaagtcctgctgattcttaatgaccaaatccaactgttcatagagagcggtggataacacatcctactgtttggatgcaattcttttgactttttgacttgttttgccatgaattgcctttaatgggtttaaatcatgtttttagttttatgagaaacaaagaaaaagattagaagcaagtaaacaggaactctatggtcagtagtagatgataatagtatattcaataatcatatgtttttctccagttatacaatttacttgaatgatgcacaattaatcaattattattatcatagcagatggggtctctctatgttgcctaggctagaatacagtgtctgttcattggtgcaatcatagctcactgtaaccttgaactcctgggctcaagcagtcctcctacctcatactcctgagtagctg

SEQ ID NO: 11 - DNA, 3222 bp, Artificial Sequence
  Description of Artificial Sequence: Synthetic polynucleotide
gaacacaataattgcacacaattttacctgtgagttaaatttaaaaacttaaataaagacttcaaatttaagctgtccaaaatcaactgttaccaaactcctcgatcctgctcccatcaaatgtattatcttccagtgttacatgttttagtgaataccatcaacacatattccatcttatacattaaaaaatccatagttcctttactccttatccagacttactaactttattatgtcagcatcctttaattctatcagtttctatccaccatgtcactgaagttataaaccattgtcttttaactagattgttataactgtctcctaaaatttctccttgcatctaaaaatatggattttctgacaaaaaaaatgctaaattgtgtcccattgctctgaaagtctgaaagtccaaagttcatggaaaagcatggaaaatctagcatggcccaatttatactctgtggccctcatttatacttgcccttactccaagctcttgtgctttgttcctctttgctctttaggcttaagccacattaagatttttgctgttcataatacacactttgtatcagcccacttccattataactgccattttctctatttataatgagttttaatgttaacttttcttacttaattttactcaaacatattttacctcacttatcactagatccaaccccttatattttcatagccctgtgcttctttattttaacatttctcagactttatattttagttaatgtctttttatccctactcaggtataagctctatgaggacatgagctatgtctgtttttctgtaacattgggttcctggagtctagaaaacatattaactacatattatcattgaatatgaaccaactctatcaaagacagttacttaagaaaggagatttcaattattataagaaaatgtatataacagattgagaatagtatattgacaataattagcaaatattaaataatataaataaagatgtgatcaacaattaaatgggagcccaactatctataatttagataaaatctctgtcaggaatttttgtagttatgaagacttcaaaaggtcacaattacataacttagccaaaagagcataatttagctaaaattacatgattacattgtacaactatagaatgaaggacaaaactaagataatttaaactcataatgttttgatttaaaagttataataattagaatcttgtcaggaattttggaaactaaaaaattctctttaacaatttccatacaatcacattttgtatcacatatttaaaaggcatcacatccaatataatagtaatcaggggtctcaaacataaaaaaaaattagacacaaacttgatctctacagcacctacacataggcaacatgcatgcacaaatgacaaaatggcctattgccatatattggtatattttccctgaaaatgaatgaatgaatggtgaaaaatatgttttcttttcccttttatgatacactatacatttgcaaagcatattcaggtacactaacataacatctcactctgcccgagatatttggtaagaaagacgagaagaaactgggatattacagtcattgcttagttagccattatgtcaagatgaaagagaaatgagtaataactatctcaatcatagaatgataacaattactttaagatattgtatttatcaattcaaactgataacaaatgcccaatttacttctgttacatacctcaaaatataaatgtgactcttgaggtgtctatcaactgatttaaaataagtgaaacttcagtgctctaagacctcaacacccagtgaaatcaaatgaagtcacattagtgtcaattttctaatatgcattttacttttcccactggcatatgtaggcaattaaaatcttcatcgtctaatgaatagacatctcctcatgtctatttctgaaagtgccgaaaggatgccttatgagatcacacagcaatcaattggttattctcacttccccccacagaatgcatctgccatgttcttcctgttcatcttaggtgctaatacaataattccttactgtaaaaactttgaaattacctcatggttgacattgccatctgctgctcacctggaagttactgagcaatgttggtgtcaaagtcaaaatagaacaaaataacatcccctaacttcatgccattctttgtcatttggcatgtacagcaaaacttgtcccaagaaaacaccctgtcctaaactatacttatttattatatgtttttgcttcaaactgaggctccagccttgtctaaggttctggatggaaacaggtgctaccctacccactctgcactctgtttcactcactttcctccttattgtccacaaatacactcacttacataataacatcaaaatactttggctaaaacaaaaggctctatggataaccaatggctcaaatagatgcttgggcacagggtatcatttaatgcaactaatgacttgagaacaaaataaggaaattctctgactatattttttagtacattattttagactagtgtcaaacaatagctagctaaattgaagttataagtgaatgtgttgttttttcttttcagattttgttcattctaagccactaatgagttgacagtgagccattaggatatactgaatatggttttgttaatacattctttcagaccagtggcatacaataggtaacttgaagtggagtaaaacatactttatgccttgttttgtttttaagaactgaaataatagaaacagaagagttggcttcctctattaaattttatagacaaggaaaatacaactcaatattgaaaaagcatttaattgtgaaatgtgtcagagatctaaacaggtatctgattattggtttcttataaatgtgacttttatagttttcagaattgcattcattatttttactttgaatttataggaatggatgtgaaattaaatagttaatgttagcacaaattaatgtattttggtatgcttaggccaagagtatgcattaatgtatataaataacttgatctatattctagagtttcagaggtcatcagtgtctaacatgtatgcatattgtgaccacctggaaagcatttgtaaaaataaataataacatttatgtaatttctcattaatctcctttgtttccaagtgtaaagat

SEQ ID NO: 12 - DNA, 3207 bp, Artificial Sequence
  Description of Artificial Sequence: Synthetic polynucleotide
ggggacaggtcaggtgggttaggctggggctctggtgaggtcaggccacaccacccaggggagacaagagctgagacacctcacttcccatgtctctcttttcacgtctcttagggcagtcttcccccagctgtgtagctcaggaagaactctcagggttcatgtggagaaagaggctgtgaccaccccagaggcctcttctccagtgagaagcagggggacaccccggaggagcagacattctaaggctgcccgtgagccctgcaactggctctgttcccagcagggaggtggagaggatgccactcaggaatcacctcggagccccgagaagagggaggtctagatgttgatttcttgggaaagggctgtgagctcaaagatgggcttaggaatatggatcacagaaaaaaatttgatgtgcaaaaatgaaaaaaaatatgacttttattaaatcataaaactgtgatgaaacagctgacatcagtggagcagcctgcacattttccatccaggcatcgttgagtctagatacgtgtcccaattatagaccatccagtcatccagggctgccacttgcagatggaaaattgtactattttcaatcatgcactgaggtttgaattacttcacagactgaaccaaacaaacatgggctccattgaagagtgtctggcatttgtttcaaccacaagagaactttccccagctctccctcattctcggttctctcctgcaagccagcagccctgcagtgtagcctgcatctcccatgcatccacccatctccttccaagggctttccaccacaccatccactgtttttgagagcactggcaggctttcaatttgtccacattctgttgttactgaagttaggatttttaggactaattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggcgctctgtgtgcagc

SEQ ID NO: 13 - DNA, 3166 bp, Artificial Sequence
  Description of Artificial Sequence: Synthetic polynucleotide
atcattcaaaacatacactttaaaaataacaagtgattctacagacctgctgcttatgaattagacaggcaagccacttatcctacataaatttgtttatgcatctgtaaatttagaatagcaagtgctgacttccagaataagggttagaaacaataatgaatatgcgagcaatttctaaattttaaggttatttagaaacacaagcattttattataaatgctagtcctggaaaattgatgtcatgtttgttatgggacttctattacctcaaagtcctttccatgtcctatcctaaatcgaagagcctccagtgacatgtcttcccgaaccttctatttttctttttctttctcgtctgcatctgtttctaacagatgatgtaacacttacatctctttaagaattctgctgggctgcttagcaggctcctctgaccaattttattgactgttgagacagatttgaaaaaatctgagttttagaatcaatattttaaaacgcagtacctttccaaaactctgtaagctggcccacagctattatggttgataaagtgctgactcacacctttttttgtggaagaaagaaggccgtatgttttaagagacacagccattagattttttcataaatgcaggtggaatctccactttgaaaagtaaatacctccagcatccccccaaaccaatcatttcatataactggccatttttacaagactccaaatacacattcagggacaatttagaggtggaaacctgtgattgttcaaaccatttgatcgctttttcttttaaggagaattaaggcagagaaatctgctccgtcccaagctcaggtgggataccacgctcagagtgggctctttaggaggactccatgcctgcaacagctgccaacagggagcacgcaaaacaggtcatccaacagccacatttcagggaatcaggggctcgctggcggtttccagactgttctgtactctcacaaaaagaaacacaaaccaacttactgtggattcgagccagtcgaagatatgcttccaagagccagagaaaggcaatgaggtgatggcgggacttccagcagtgccacagctgggcgtgtgctcacttaccagcttacatactgcctgggtattgtttatggccattgcttttctatgtgaacgtatgatgagggttgatgtaaatctatgtcaaccatataatccaataaagcaggagctgtgttttattaaaaaataataaaattaaagtactttagggataagctcatggtcttgggagaaaatatattttctcagtgcctcaatttctcagtccatgaaatgggtgaccagataccatgatgttataaggtgttgtaagacagaaaaaaaaataaaaattcaaatttaactggcattcaaatcacctgagtctcttgttgaaaagtaggttctgattcagcaggtctggggggagatcagatattctgcccctctaaccagctccctggtgatgctgaggctgtattctggggaccacacggtgagtagcagggagatagaggagaacgctattcctaggcagcatagtgttttatgcttcctagggttgcctagtcagataaattgaagaaaaggaactttacagtgaaatataatccaaatgccataagggctatcaaaaggcaaagtgcattaaaatattttattagaaacaagatagaacaatgggaagacttgagtaattgtttccagtctactttcaatgtgtttcctgatgaccaacatccaactcatttctcctggctcagttcagctagtgaggactaagcagaggtgtgttattcacacctatttagatgctgtgtcctggattgtcgagcacagccctcattttaaagttctgcttcatcgctccttttagcacattctattggatcataaatccttagttctggttcagacaacatggccactatgttagtttaggctgtctcactgctctaacagctacggtttcgccttatgctggctggcgtcgagttggggctgcacactgtccttcggggcccagctctcttcttcctagtggctctgctgttccctagagtctcaagttccttgggtcctctgcatttgggtgatgttttagagaccaggcctgaaagtggcagacatcgcctcgtctcctggtgggagcccagccccatgactcccctgactgcagggcacgcagagccagacacagggccaggagggaaggaaacacagcattctctctgcccggctgcccatttagcactaggtggattattaactctctaaacaatgaagaacacactggacttgaagagtgagtgccaacagggaagggaagggacggcagcggaacgtgagctcaggacaggctctaagctgggccttgggacccatctcttgcccagggaaagggggtctttggagaactgttagctccctcagaccaaatgcattcccaccacagccgaaaggcctcccaggaactagagcagtccacgagtgaggcccgggaagaggagtacaggacagtctgcagatacagggggtctcaggtgcagctcagaccttaggaatctgaatattcccccaaggcccattccaccccatccatgcctgacaaaaacactccgcttcttgatgaggaaggaatcattacccggggcccaactggactgcccccaggggtgtgtgtagggggtggggggtgagtgtggttgtgtgtgtgttgtgtgggggagtgtggttgtgtgcggggtgtgtggttgtgtgtggggttgtgtgtggagtgtttgtgttgtgtgtggtttgtgtgtgtgtgttgtatgtgatggtgtgggtgttgtgtgtgatggtgtgtggtggtgtatgggatgtgtgtgtggttgtgtgtgaggtgtgtgtgtggttgtgtgtgggtgtgtgtggttgtgtgtgtgggtgtgcgtggttgtgtgtgtgtccgggaatggcaggagagggccgtcacagttaatgtatatgttacactcagagaagactcttaccaccaaagctcaattatttttcaaactctaaatgcagacaatgtagccatatggaaaaattggttgatgacaacaaaatggtttgttgttgttgttgttgttgttgttgtt

SEQ ID NO: 14 - DNA, 3160 bp, Artificial Sequence
  Description of Artificial Sequence: Synthetic polynucleotide
cagcaccttgattttggatttcctaatctccagaactgagagaaataaatgtttgttgcttaagctacccagtctatggtatattgttacagcatcccaaactaagacaatatcagtaaagagaagtgtgtttacattggttaagtctttctgagtcaataccttgattgtttcattgttatcaagttacccattcttgaaaaggagatattactttgaagcgacgactagcaaaagttcctcaggaagcaaccgtgatgataaacataggagaaaacaacacacacacaaaaataaacaaacaactgtgagaaacaataagcctgagtaacagttactataaaatgtggcattcaataaaactctaggtgaaaatttgacccctttcacaagtgaaatgagcaactggaccagtgctatgaagttattgtcgatagtttaaatgtaaaaagtaaattatggttgcaagcatttttttttggatttgggagctatgaaaagttcaggttatatataaactcgctgcagagagggcataaaaacatagtactacattgatctgtccttgcactatacttactttaaagtggaaatttttaagattcaaggtcttttttcagtgttatcaagggaagtaggtaattagatacttacaaagactatttcatataataaaaataggactgtttgtcctgcacagttcaagatatcataattgtattaatgagatatatgctattattttagagatcatctttattattcaaaaggagccagtcatcctgtactgaacactcaggctaactctatagtcactatcaatttcactgttttgtgtggtctgattaatctctatgataatgtgaacttaggtaacaatatagaaaaattaccaaaaaagatgtataaaatggcccttgctctgaaggatctttaataaagatttaaaagtaatcccaatgaaactgattaagtcaattaaatgatgtttttaataaatacataaaattcttacaaaaagacataaatcttatcactggacataagaaggcttgatgttgaaagaagtgagatctgaaaagataatgaaggatgctatggtcagaaaaaagacctagactaaggcaccaagggtatacaaaaggaatgggttattgtgtgtgggaagctgtgtggatattgacttgagtgagtctatttagaaaaaatgaaattattgtctattttaccaccatgagaaaacttctagatgtattgttgccaactttgaaggggctatatcttcactttgggtgtgctgtgggaatatctcagaggtaaaccatttgaaggtcacttgagaataaagaccacttcagggagaaatccaaagattgtccatttggcagtagaaaatgagaggaaaattatctcaaagggaactgagaaagattttatcactcagacacagacaaatagctcccagagccactgacattgtagttgagtgagaggtccatatggctaccaaccatgattggaatgttcttttaaaatcaggtaaaagtaaattctagtggaagaatacttgattggcaattgggaaaaaatatcaaatgtatttagatgtcatgaaagagaaaaacaaataatgttctcaaatgtcagcttcaacttaattatgctgcagcatctaatactgatttaatgagtaaaatcctgaaatgaaaaggtaaatctaaagccatatgcctttccaattgttaagtatttatggacaaatttattaataccctggagtttttgagatggttacaaatacagaaatattcagaatccagatgtagcaggcatgtatttcaaaccaccaagctaagccatatcattaaatacttctatttattcttctatacctctatttaactgaattcttttctaaggagaagaaaacctcaccccaccaatgccagcataccgtaggttgtcaacacttatccctacttaagcttgatatccatgtctatgctgctaccctgttctccagtcattaggtacttgctatttactctgtctatcctttgcaactaaaaggtctctctggcctatcttgaatcaatatgggacaggacaagctattttcagatgatctcctgcatcgttaaggacctctgatagactgaggatgggtcctatttcaatctatatatcggactatactgttttgccaccattacaattctgctgatgctagcctgtgtgagcagtgaattctccatgagattatatctcttctgagttccataaagcaagttgagcacaaacactctctggtctctgagtcccatacctatgtgttggtttctgtttctctctacctctaaaatttcaacttcagaaattgacaggggacagagcccactttttagaaaatgataaccacagactcattcccttggcttcctgttttagtcctcttgtagaaaacagagttattcctgggatatggttatttgtcagctttctttttatctgactggggtcaagtaacttcttcaggctaaaaagtacatggaagatattttttttttcctagaccaaggcagttaagcaaatgtacaaccttaatattctccttcttacattcttggctacctgttaacacccacgattatcttaaaagagatatatttaaaaaaacaaatcttccatcagctcagtgtctgtcaatgatttcaggaggcagaactggcctttgtgccactcccagttacgaaccattaacaccttcacggtattttaatgcattcaaaaatatactttcatggttttaaatctcataaacttagcatttgtttgtcataatatctggtatgactgaaacaaacacatttgtttacagagaaaccttaagttctgttgcttttagtatttgtctcttcacatttaaaaccaagttttagaaatgtaaaaaagaaacaacttttctgtcttaacaagctggctctcatagacaaaatatagtttgtcttttacgactttttctttgctttaactctgcaaagcatattttttattattattatactttaagttttagggtacatgtgcacaatgtgcaggttagttacatatgtatacatctgccatgctggtgtgctgcacccattaactcgccatttag

SEQ ID NO: 15 - DNA, 3098 bp, Artificial Sequence
  Description of Artificial Sequence: Synthetic polynucleotide
gcgctctgtgtgcagcaaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacagtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttctcggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctatattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttacctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcacaggaccacttgggggcgcacaggacccactgagcacaagagccaacctcagggcatgtgcagatgggggttaaggtctggtttcctgtcagccctgtggcttcctctccataaaacagtttcctttgtggcatatctctggattccttatcctgttcttcctattcttcctgaagaagaaacatttgtcgtaacaagagaaaaattttctcacatgcaccaaaggcagagtcacctacagtcaattagtcctgtttctcaatgttaataaactatcaatgtttctgaaggtacattgtacagaacccagaattgagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagtttcgttactgatgtatgattcatcaaagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttattt

SEQ ID NO: 16 - DNA, 2967 bp, Artificial Sequence
  Description of Artificial Sequence: Synthetic polynucleotide
tggggcctagaggcctgggatctagctgcacacagagcgcggcgctctgtgtgcagcgcaacattttatttaattatcatcatttgtctccaaaagcaaatatttgcaaactacatgaattcctcaaacactctatatctttatttgcagaaatgagaaagaaagcctcaggctgatggcttttgttcaaattatacaaatgtatgaataactataaatgactagttattattattacactataacagaaataaatgaattctctttatttaaacaactctttttctctaactaaagtcttctttgggagccatgggagatctgaatatgaagcaaactgtttttgttttaaaatattcccaaacaaccatgtaaacaaggcttttatgttgactgtgtatattattgttctaactaaaattttaagcctcttaacaggttatttattttgccgtgtaaacattttctacacattctggtgtttagagagaaaccatccctcaagcaacattatttaaagcggtttttcattagtcttattgttctggaaagcggaaactattgtatttctaagataggttcaccctctttatgtacgtaattctgaaaatatctgaaaggttacattttaaactaaggtcattatacaaataagaaaaacatttatttaagacggtttatgaagttaattattagagtttataaaaaacaatttaatgcatgtatgctatcaataataaatactgtgaaaatatttgtttaaagtgtggtcatgcaaggctcctatatgcctataagagtaagaaacatatgtaaatcaatacagttctgatcattttctaccatagcgccaggttcccttcagaaacctatgctagattgttcacattccacagggagaaacagtagatttttcatttgttggaattatgtttcttattctaaaagcagagaattcttatttccttacttcaaattatcaaactccatagttaaggagtctttattcaatatctttccatagtttattctatttcatttcctgttagctatggcagatgctgggtaacgtggaaatttaaggaacaggaattcttctctgatggcatgttttacacattgctgtaaaaattgctattgaagccgtgttataggtgcttctcctttattactgtgttgatgtcagtgaaaggatttattaaaaactaaatttttttatggaaaagacttctatcactctaagtcttcacccactatttaacaatatattattttgttttgaccccctcaattacactaacaaactctcatctctgttgaggtaaaattttgctctttaaatctttcttgctcagatatcttagggtataatttgaaacaatttaaaatttaaggggatctcagagatcttctagtttgctgttcctgttgtacagatgatgatataaaaaaatcttaaagaagtatgtgactcagttaagggtaatccactttttaaagtcaaaggaagccctggaacacagatcttgtgattccaattttatgatttctttttaactattacttgctgactactcagtatccttttcctaatcaagtaaataaagatatttgtaagttaattttctatctataattgattctgcctgagacacaggaagagctgtttgagttcaacaatcataatggaaagcaacagcgataagagtgtcccttcatcagttcctgctaatttttcatcttattgagatatccgtctgtttattcttgctgttattgccatatttggaaactgggaatatacagataaattatagagaacatctttcatcatgtctcctgaggagtgttcaaacaggttggcattttcaaaggaagctttacctagatgacagaagaagaatagcaatatcaaaaacagtcccctctatcccttccctaaagaaaaaaaaaacaaaaatactaagagaaagaagacaatataaataattaaaggcagacaacttcataaagtaccaaaattctctcatgataaatgctttctttgtgtgtgagagggatataatcttgaacaaaaccagaaatgaagactgttggacagtgagagtgtcataggcctgtataatgagaactccttccagacttctgtagcatttaatgaggagactgggttttggtagggtgagattacttgtgattttatcactacccatgcctcagtttcttttgagacagaaaaaaacctgagaagggggctctcttagatatcccagcagggtgttagataagccatgcttctggctttacaatactcactctgactgtccttccttctagcttccagattgcccaccactgtgtcttcctcccacgtagattcagtttcctgtctaaggatgggtctgctttacagctcagttgctgctttaaaaagcagaactgctcagcaattgaaaaaaagtgtttccacgtaaaagccaatccatgcaactgaagtaagtgactgtcacccaggatgtgctgatatgtcaatttaaagatgcaagaaacatgaaaaagcaaggaaacataatgccaccgaaggaaaataataattctctagtaggaaatcacaaaaaagaaaaatctataaaatatctaaaaaggaattcaaaataataatattgaagaactcagccagatacaagataacacagataaacaattgggaaattagaaaataatttataatctgaatgataaattgctagatatgataaaaaagacaaacagaaatcctgaagtgaagaattcaatcagtgatataaaaatacaatcaaaatcttcagcaatagacttcatcaagcagaataaagaatttctgacttgaagacaggtcttttgaaatgtcatagacaaaagaagaaaaaaggacttaaaaagaatgaagaaagcttatgtgacatatgggggcgctctgtgtgcagc

SEQ ID NO: 17 - DNA, 2953 bp, Artificial Sequence
  Description of Artificial Sequence: Synthetic polynucleotide
gggggcaggtggcttgtgggcagcagtggaggggagttttggcctccatcttcagtggtgagcaagcagttcccctcaccagctgagagtgctgaagttatgtgggcagaaggcgtggctgctgcctctcccaggacagactccctcactggggctccccggccactgccctccccgagagggagatcgagaggcacgcggggcctctggctacacaagctgcttgctcctctttgcagaaccaagcagaagaatcaggccataaatgttttattctagagttttctttgggaagcaagttcatgagggtctgatttacaccccgtgtaatggagtggtggcgagtgatgaataatgcatgcccatttcactgctccttggggtgatgacagtgttttctggacttacattaaacatttaaatgaggagatgtttcttcttggggtcttcatctgttccatagtgtcaaagaaagagactcggagcccctgtacagcctgccaacgcccagaccctcttttttcccttttagtaatcccagcagggaactaatacggcctggttcccagccactgcttaggggccccattaaaatgcagcggaggaggctctagtgtctggttacaacctggcggtttagaatcggggaaccgcggccacagcactgcagccattgctgacaccaggcttccaaccgggggaggctggaatttgatgaaacacatcgccgtcacagatgacagcccaatctttactgactagcagctccagcgctgtgtgccattcacctgtgagctctgtgacagggagagagatgcaggagcaatggagcttgcctggatccagggcactgcacagtcagactgagctccagccctgacctcggtgcggagggcccctgcagctccgtgcacccagggggcagcatcagcgtgcacgctgtcactttactgtttgcttgtgctaagttccatcagacaggccatcctctcctacctgtagccctgccagccgaccttgcactactgggctcatgtgaaatgctcacaggctgtgttgttgagcatcctgcccgagggagggattgctggagttgttctgtagggtcagtgactcagagaactgggccactgcatgtcggccagctccttcggaacatgtgtgtccacttgcctaggccaaatcctggcaggtatccattatggagccttttaaaaagaccgtggtgcaaacgtactttattatagtcagagccctttcctgggcatgggctgctaggcgcgacttcgtgggagacagggctgcacttggctttgaagtcggagcagagatttccttggatgatcttggagataggatgaacatctgtctgagggctgtgtccccagttatttttactcaaaggcacctggagctctttctcttttcttgttttatcactggctgactccctcactcctgccaagtctttactaatcccttaaggcctagaatcatttaaaattaagccattaaaaatcaaagcagcatcagagaggtggctcgtggttaggaggaagccaggcctgcatccagggccaagcaccatggttggagctggaggcaaggagccctcaagtccctggtgtcacagtcagcaactctcaacctcgttatgaatacttcaggggagaggcgccattggttgggggctgaaagtacatccaggcagtgcgcagctcaggctttgcaggatgctggctgtgtggaagtctgtgcctttactcaggagttcccaattacagtcatttaaaggagaggcccctttccctgcagttagttcctgccagggttagcagtggctgctcatctctgcccctcagcaggcctcgtgttcttgggagtcacattctgtacagctgggcctgtggcccccagtagcgtgctgctgagcctgtcagtgggaggacccctgaccccctcccaccttggccaccagcaaattgctgctcgtttgcatccgtagcaacagagaccagattcagaggatggactgaccccatcagcatcgggaagccacgaccagtgtgccactcacttctttgtacttttagttttcatatccctgagggcagagcccagcccagcgttgcctcctacacagcaggatgtccctcgcacccctcgccctgggtaccacaccacacacccatgctaggaaggccggccacacgggagccacgctcagccatgtcagttttaggcattcttcatcttgacctttgggaaaaagcatttccacacatctgacctctctctgctcttcattccagctctaagtaatagcttactgttaaatcccacatatttgcttggagcttttgccatatcaagtgtcagctgaaggccaggattccagtgaagccgccagaatgtctccctcctgctgtctttagggacagcctgtgtcagggtggccaaggccccagacccctgaatgggccctgtggcagctcccactgtccacacctcaggttccttggctgagccctcccgagcctcctgacaccgagccctgtgggttgctttacgttggactcacgcagggcagtcggtggatgccggcacagatgggatggtgagccttcggccgccgtggtccacgatgcgtgtgctccgcacagtgtgcactctcagcctagccttcagcctctgcccagcagacaaaacacagtctccttggtctctcctggccaaacacattgcccccctttcattggagtatggcttgagcagctccaggacattgggaggtggagatctaagtgctggggcaggcttcaggcaggccaccctcccagtgtggccccagcgtggctctggctgtgctgtgcttgtgctatgctggtttgggacagcttggctgtttctggagcatttatctgaacaggacagcaggcatggtaacaacagc

SEQ ID NO: 18 - DNA, 2917 bp, Artificial Sequence
  Description of Artificial Sequence: Synthetic polynucleotide
aaatctgacttcactggagaatcaactatccactatgtagatgatgaaattcatgtttgcaaaataaagtgaaatctacatccttgtatctgttgtcacatgtaattcagacagtgagttctatgaaaatcaggtctgtatgcagagataaagatcagcaagatgttctgatttacaattctgtgcaactcagctggttctaattcacttcgaaaacaaggatatgatgatttttatggttctttaactacctatttggtgaattcatttatgtatttattcatttaaaaaatatactgagtttccacaaagtgctaagtattgtgtccaaagctggagaaatagcaataataagataagtaagatgaaatatcttcatttcttactctgagcaattataacaaaatagcataagtggagtagtttataaacagccaaattttttttcccacagttctgggtactaagaagtccaagatcaagtcaccagcaaaactggtatctggtgaacacccactatatgactcagaaggaaccttctcactctgtcctcacatagttgaggggaagagctctggtttccttggcccttataaggacactaatccaatttgtgagggctccatctccgtaacctataattctattaacacaaatcagtcctaacatttagaggtcaaatggagacagcacagctgtcaaggagtggtggctgtcacagacaagtgtggttcaaaaaagccaagaaaaaggagtttttaaagaaacagggcatgagcaactggtcaactgtgttgtgtgctaagagatggaataagaagaggttagagaggtagctattgaatttggcaacatgagtgttccccgtttctgtggaattatgaagatgaaaaccttattccaaaggattgtgtgagaggtgaaaaaatgagaaagagaagccagtgaatatggacaactatttccaaaagttttgctgaattgcgtgcaaaaaagagttgagtaggagcaaaaagggtacaggtgttaatgaaatgaatttatattcccaaattttgtatagttgtacacataactagaaatatacatacatataatgcaatcagaatatgaaaagagcatgggggaaaagggagaaagtaatttaccaattaacctctacttaaaatcttctcattaaatgggaaatttaatttataagttttcatacagatttgtcccactccaaatctgtcacttaaattacagagtaagaaaactaatagtgtgtagaagaaatatgaagtcaagaaaaaatataaatattttcagccattatttgcaagtatacaaagaactggtggagctgaaagatacaggaattagttgagtggaaatacggcagagaaaaggcacactcctgtttatttatatattgtgatgggtgcaaatgagctgtgtagaagtctgagatgatgtctcatggtaaactagcaggagggaaatcatgaaagtattcagaaactaatagtggagtcaaatttcactatgataggacagacgacattaaatctcccttatattgaagtttgcctgtctaggacagtataatttattttattgtactacagaaaagtaagacactttgtagatgaatcaatctcatattcaattttggtcacagatttaaaaaattatcctttatatgtctgcttttattgaattgctcttgctagagtaaaaaaaaaatgtttctaattcagtttttgaaaattttatattcaggagacttacattattggtttttggttttttttttttcggcattttggcacatttggcataatgaattgtcaatgactccctgacccctagaaataactttggccacatgattaattgaagatcacaggcctctttatgatgcaaacaccctgaagggataaatcacgtgtcctatctctcaacctaaagcccagcacacagtattttaaaaactgttcaacaaatgagagatgtgccacggaagacctcatccaggaggtttgatgttcagagcactagtcctgagttttaatattagttatgccgttgatctgcctttcaggtctttgtgaagtcatttagtgttcttgttttaattttatccatacatttgggataacattacccataggataatacataaaaggctttgagaaaagttaaagtactaaatgtttgtacagatctagctaatcgtgtaaatgcagcctttcattccttctgtgtctgcacctaccaaatgagagaactaaactacatattgtactcttcactctctctattagaacagtctcctgttctaactacaacttttccaaattgctgaaccagagacagggttatatgaccttatttatcctttttaaaattattaatagtagtgattaccaacgcacactttttttttagtaaaataactttttatttgacatctacaagattttggcatcttgcagcttttggtttatacaatcttgatttttcaataaaaagaaagaaagaaaaggaaataaaaataccaactgctccctcacttgttttataaacatctattataggcaaaacaaaacttacccatattatatagataagtgtctattcacatttgtacattaccatttttaacagcttgagataaactctacgtcttacaacacattaaacaatattcaagttactgagtaacaacaataacaacaataacaaaagaacacacagcagaagcctcaagtgtttcctcattgtctacaactcaactacggtttcctttatatgagtgacaaagcaaattaagattatatatatatatattatatatatatatatttttttaaatcacactcttcaaaacaaaatgacatttcctcaaatctatactaatttttagttgtgg

SEQ ID NO: 19 - DNA, 2903 bp, Artificial Sequence
  Description of Artificial Sequence: Synthetic polynucleotide
gctgcacacagagcgcagtttcaactgtttaatcatgttttggtctttctggtgaccagcccccattcagaagctatctcaggcccaccaagagtggcctcatgtaaaaaaaaaaaaagacacccctgtcacccaggaaatttcaaaggttttcagctctgtgtcaggaacagaggacaaagaccaaatttgcatttctttttatcaaagtctttatgctttaaagacaaagctacttatccttgccttctctagagtatgtttcctttgaacatttgtacaatcagcaatggctcccttaaaaccatggttgattgatatttatgaaaatttgctcttcagtcttgacagcaaatgacacccatgttcaaaaaaagtcttcccaaaagttcaatttgtacttctaatatttccattgaaacacaaagtatgcttctcagaggatacttttacagaagtaaggaaaaatataaaacattctaccaataacaacaaacagggcaggtaatattagaggaactttttataattcttcctctgccaaaatgtcagtaggagtgaccatcttcccatgacacaacttttataaaacaactgccacacaccatgtcatagaattcttcattgagtgacaattatgttactctgatgtcattatacttacactagcaccactcaactttactataagcttttaaatcaatgagaaataactgagagctaattttaattgtttgcacacagcaaacattaaagaaattactttaaatcaggaatcataccttatttctcacgtactttttcctcatatcatatttagccttagaaaagaaagatttttatgttccatatttggtccttacagttgtcaacacagtggctaaagattgacttttttccattcttgtgtatacacaatttatttccacttttctgctataaactccaaaaatggatttatgcactcaaatatttgtaatggggcacaaaaatatatagtactatgttatcagagaccttaaaaaaagacaaataggacttgagcagtatgagagagatacgcaccttagaaagatatgtaaattagagctatggctctcctcttaaatatatacaaaataatttgtgtaccacagaaaaatagtggaccttcgttacttacctaaaaaaaatatattgcttgtctgaagaggaggatgaaatgaaatgtgtgttgtttgatccatgaagctcagttcctttgagaccacacctaatcaagtaaaaatgttgggcaattcataaaatagaattaacaatttttatggaatttgtctgcaaaatactatgtttcattatatgttagttatgttcttcagtgttttttttccaattcatcttacttaaagcatcgttcccaaatttctgacttctaattgaaaaaattccaatactatgtttttcctatagaatgacttctcagagaaattatctcctttctccttctaccatactcttttgagactaaaacattacagcgcccttcaaaatattatatttagattgaatgaatagtaatctcatttttccatagctttggtttatcatatgtatgagtaacagttgatcagtttggaagccaatggcagatttttcaattttgtaatgacacatttaatatacaacatacgtttatgtgtatctgctacatcttaagtaatgtgtttggttatgctgaaaacaaaaaggtaacattaaccaaaaatgctctaaactaaaaattttgaacaattggcttttttaaattaataaaattaataaagtggtaaattgagtggaattgcctcaataatcaatacagagtttattaaagataaacaaagttatataattccatcaggaacttggagagtttttatttgcagaagtcaaggaaagaaagtgtttcatgaaggaagaacattatttttaactatttttagatgcttttcttaagggaagcgttcataaggagttataaacgtgtgaacaatttagcaattaatatactactttaaaattatttttatatgctcttattgggaagaaaatctttcctgtatttacaattatcaaatgttgcatatttctaaacaaatgaggatattactgggttttttttttctggccatatgaataattttggcactgtgtattcacataagttgaagcacctacttttgcccatattatcagataatttttgtgaggacaaagatttaaaaataccaagaagaggttaaaatcagcacaatattattgtccttactgttagaactcttctgtacatactattatgtgctaacataccagtcagagaaatagccttgtgcacagaaagttcatgttctaagtattacagtatagaattaatcagtcagcggatcgatcataagaagaataaacctgcaagaagctatacagtacttccatcctaaatctacttttccttttaaagcaactgaacttggcctccagtcaccaagaaaagaactaaatttatttctatacaataaaaagatgaaaatactgtctacaaaataaaagatatgttcacaaaacagggtatgctgcactgtatttgaatttatatctaataaactatcaggaagtttcttttaaaaattacactataatagaggaaggaaatagtgcatcctaatcatcaaggtaaatttaactttcacagtatatgaataaagaattatttcataaaacagtaagtgtgcagatgaaactcagtaaatatttaaaatcactactaatattcacactaaaagttgtattgtggcttacacaatcttcagaagaatgtttataaatcaatgtaaaataaaataaagaacaaacagcaaaatacagagtataacaactacatatttatt

SEQ ID NO: 20 - DNA, 2887 bp, Artificial Sequence
  Description of Artificial Sequence: Synthetic polynucleotide
gccactacactccagcctgggcgacagagcgagactccatctcaaaaaagaaaagaaaagaaaattataacagaatatttaatatgatatctctcccccgccccaatccatctgaataaaaactaagtaaatgttagagcagctgtattcaatatgcaaaattatgattattcctgctccaaggcaagtaaaaagcaacacaatattttccattttaaaaaaatgtatttcatttcagaatattcttcctacagattattttttaaatgcctttatttagtcattttcttgttctcagtttttcgctcaaaaattctgtcatttctctgatgtgttcattttagctgcaaacacctaatcagaattttaaggagaattagtaggttggctaactttcagaaagaaatactagtggtgttttcaacaggccggcaggatgtctccaattataaagacggaggaaataaaaacaacaggatggtaaaatccattgagggacagattgcattttataggaagagatgtaacttcatttaccttcagtctttatgtcttgcaaatgtgctcagcactcctacatcccatgggtctcagcgtcaatatttatgtgctggaatacttcattgcctcataaaccaggaggtaactgagtattttcactctctgggaaaaaaaaaaatgggttatactaggtagtttccaacagctccacttctcactcatacttctatgcattgacttgcaagaagacacaaagctagataaatgagaagcgttgatctttttcttcttgctccttgaattagatgttaaccatttctaatttcttgttaaacgttattcagctccaaccaaaatttcaatcatggataacctaggggtaaaggcttgaagcttttttaaattttgttttaatgtaaatttcaaaagtctttatgggggcatgtcctagtaccttaaacagcaaattcagattcaaagttgatgtccttccaaaaagaaacacagaggacttctaaataaatgatccctaaaagacttttaaaaatatcgacaaacattgcattcgatatccagaaacagtgagtatttctcaatggagaatcactcacctcatgaagagtcctcatgtggagtcccagattacaagcctcctttctcaattccacagagggttctcagtctttaagtatcatacatccaagttacctggatgcttaccctctggtttctgctccaaagcccttcattccatcaatatttttcatctgtattaaatttgagagcagaatccaggctcctgacagggatgagctcatacatctaataggtggtcatgtcatctaccagccaaaccagtctcccaataaataagctgttttccatactgtgttctacagacttgtattctatgggatgttttctctccctctgtctccctatctgtctccccacttccttcttttctctcttcctctcttttatacaaacacacacacatacacaaaggagtttgtaatgaaataagcttgaaagatgtagacttaaagtagctctatttgttagatgatatctcaaagcatatatgttaatatgcattatgaatctccaaaaaagtgatacaggaggtagtgttttccaaatatacttgagcacggatcatttttttcaaggaatgttctttattgtcacaacaattatttcttgagctactactatatgtcctctgttgattttcctaagtgcatacgaagataaataagacagatttcctgccctaaagaagcttataattcaatgaacataccacattctccacaactgtgctctctagaaaggtagccaccacccacatgtggctattttagtaaacaaataacattaaaaactctcagttcttttgtcccactagtcacattgcaagttcttaatgaccacatactggctactgctgccatactggatggtgcagttatacaacatttccttatttccattgcagatattctattggacagaggtgctctaagcactaccttatttgtattaatcatacactaataagcacgacatttcactttttatatattttttccttgaaagactacaaactttttcagatctcatacaatcacagtcatcttcttattgcagttttaaaaattcactcagattgctagaaattatttctagttctgttaatttattcttgcagtgggttgttttggacgtaatctgttacctaatttcaagggcattgacatgagtttacaatcagaccaactctatggttggtctaatctgatctgattttacagatcctaaaatcagagatttcagagtctgcaaaagcacctagatgttatttaatcctattctcccaattttgtaaagtagcaattaaagctcagagtcattaggaactcacgctggtttacaaagatgttaagtagcagggccccttggattcatctaagtaaaatttagtggctgtatacaactccctgagccttatatattgtcctcagaaggaataaactgtggcatagcacactgctggctaacaagtacacctgtacaaagacaggatttttctgttgatattcctatgctaatgatgtaaaatggagctcatctccatgagattattatcataggcattaacttttactgaaactctgtgggtatcataaatgataagccttatagagaaatatttgctcaattacaaagtgtgtgtgcatagggtgtttacacgtgtgcacttgtatgcatatgtgtgcagaatcaggagaaaggatgtgttttttttaacttttaagttcaggggtacatatgcagatttgttacagaggtaaacttgtgtcatgggaatttgttgtacaga

SEQ ID NO: 21 - DNA, 2873 bp, Artificial Sequence
  Description of Artificial Sequence: Synthetic polynucleotide
gtcccctggcagtaccacagccttatcctttggtcaagaatctacaaccttccacagcaacccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctactgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagtgaagaatccagcacatcccacagtcaaccaggctcaacgcacacaacagcgttccctgacagcaccaccacctcaggcctcagtcaggaacctacagcttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctcccacagccgcccgagctcaactccaacaacacacttttctgccagttccacaaccttgggccgtagtgaggaatcaacaacagtccacagcagcccaggtgcaactggaacagcactcttccctacccgctctgcaacctcagtacttgttggagaacctacaatgtcacccatcagttcaggctcaacggaaacaacagcgttacctggcagtaccacaacagcaggcctgagtgagaaatctaccaccttctacagtagccccagatcaccagacagaacactctcacctgcccgcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcaacccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctactgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagtatgacaagcctaggcgtcggtgaagaatccaccacctcccgtagccaaccaggttctactcactcaacagtgtcacctgccagcaccaccacgccaggcctca

SEQ ID NO: 22 - DNA, 2867 bp, Artificial Sequence
  Description of Artificial Sequence: Synthetic polynucleotide
gtttcagacagtgtctgatgttggaaagatgaatctaggaaaatggtgttgtaggatgccttcaattaaaaaacaaatgaacaagaccagggtcagtcagcactggagatctgtaaggaggggcaagctccctcttgcagaaactggagccaggtggggttcaggactgtgtaacaaaccttgtactaaggatgtttggcagagtaacagggaataatttggggttctcatactaagtcctttgtttcaggggtactggaatggtaatgggaaatctgaggagcagctcagtcaggaagggcccagggaatactgcatgtctgggtgatgggcacaccccgagaattcagcagtgcagagcctcccatggcttcataggagccttgctaggagtggatcactggatcccaggattggaaactttcttaacccctgtgattattcctctagtcccacgagcctttttcctcacagttatgccctcctggagtttccagagtaacctacaaaatacaaagaaaaagccatttcattgtaactggtaactttatgttattatcaggatgtcaagggcctccaggggagagaggagtataaagttttaagctttggacccaggtttatagagatcacagaagtctcttctccccaggaggaaccctctcctctattaggaggggagacttctgatgttaaaacttatgacagccaaggcaagtagtgcctccagactcctactgccccaggctttttacagtcaagaccttcatcaggcttctgaatatccaaattgcctaccttttacataccagaggggaacagggaggattaccaggatgtcttaacagagttatctgtatgaacagaaagaatagagcatttatttgcagatttatagagcaatgaaataattctgctttataactaccaaatcccaggccatgggaaggatgtggataagatttcagaatggtttcaaaatcactttatgatttaaatggttcctactctgtggtttctacttctctgatgtacttttcagccctcacatccaaggtgccgatacaccatgaacaacttgcactattttgcagacagtgggatgacagagagaggagtccaaggtgacatttgggctcatattctttaagctcaattttttacctggaaaatgagtataataagatgctgctttctgtagggttgttagtgaaacaatgcatgtaaactgctatgtagtaagcatctaataaacaggagttgttattatcacattcacatctcccatactagagtatccacgccacaggaggacaagagatgaccttattcacctccagatgatcacatagtctgtagcacataacaattggttggtgattgctcaatgaataaggaaatggactgaactactcttttcaatgctatcaaaagtttttaaatcctagtaataatataattgttttaacttgtatgtgcaccagtcacctgacatgccagttaaaatgcagaatcctgggtcccatccctagagattttgattcagtaggtctgaagtagagctcagcaatatgaatgcaagagaagttcctcagatatttctgatagaggagggtcttggtctaaactttgagaaatacttttaggttcactggtttacaagttgaattgtgcatgggaaaagtgatttctgtatatcagttggggttcagggaggacaaaagagccacagtaagtattgtgggaataagggattgaccatagaaatttgaacttacgcaacatggttgggaagaactggggaagggaaagtctggaaaggacagtaggagagccaaacagtcactaaacatgattaataggagacctggtacaggtgggtaggtcacagtgtgcaggaaacccccatatcctgtgtgtgtgtctgactgctggtgtggaactgcaaagaaggttgacagagaagtctggagagcctgtgcccctgaagtttgccttggggctgcttttgtttagtggggccacttttgtttggtggggccagcgttagaaagaagagatggaaactggaccccagtagctgcattcgtatctgtctgtcaccacgtctgcccactgtgactttctgagaataatgacttcttcatttcttctgcaagttcctcttttgggtaactccaactcagatccacataggacagaagcttctggaccatgtaatttccagctttcatcaagtggacatagcacactctgacacatcttaatgcactaaaaattacacgtttgacaccctctccatcctgctgcttttggtctctgagtgctgggtgttcactcttcttgagtttttgtgtatttcaagagcacttttgagagaattccaatgtttttatgagtaagaagtttgtaactttttgcaaacccaagtttatttggcatgttgggaaaacacgcacagtgagctgcatccttgagccagcctgtcatcagtaaataaaagacaatagatatatatgtgacatgagtggaataagtttagaatcatattattagggaaattggcattttagtattcagcctattacaaacagagagatacaggcatatccttaagatgggcatccctgggcagcttcaaagatgatctttgtgaatgaacagctctggagatggtgggatcctgtctgccaagtaaaagtggaagatgactgtagtaggttgactaatggcctgtgtattaattcattttcatactgttatgaagaaataccagagactgtattttataagtaaaaagaggttttaatggactcacagttccacatgtctggggaggcctcacaatcatggtggaaggcaaagta

SEQ ID NO: 23 - DNA, 2863 bp, Artificial Sequence
  Description of Artificial Sequence: Synthetic polynucleotide
agccacaagtgtggatacaaaaagctgtcaactggccctttcccttgctggcagagggcagctgctcatgtgaaaaggcagagggcccactgacctgttagtacttaagccatccacagatggcagagctaaatgagcactgtaacactccctctggggcttcagaggtcgggggcaccccacccagaggctgctgcagggcctacatggagtttgctcttgctagcacccaaaagcactcgctctgacccctgcacgcacccactcacctgtgcgctccgtcctgtgaagggtggagtgcagtgcatccgagtgagtggagtctgctcctgctggcaccaaagtgtctggctggttccagcattcatgtactccagtttccgcctcgtttgctcacacactccctccggcaaaaagctgaaagctgtgggctgggtaaatgaggcacccccttgcgagtcctgcgaaggagtcatggaaatatcctgcttcactatgatgaaggattctaagaatccaacacattttagaaatgtgtattctataacataacggtggaataaagctgcaggaagacagagagtgcatgttagaaactctccttggtgttttcttttggtttctttttgagcttcataaaaactctgtgtggcaacaaaggtggtgcttcagtggtggtctctgagcacaacgtcttctttgtttatttctctacatctgagtgtcttgcagttaagtttcagctatgccttttaccttgtgaccttgtgacttcaattcaatgttctcaaattaaagggataatacctttctcaagtcggttttgaaatcaaaaggaaattgaaactttcaacttgctatgtaacaagtgtccattattattacttacagtattcttatctagatagataaaggaactaaggtccaaagaagatgagagacccacctgttttcttacttaccagcatcacttgccttggaaaagtgactttgtttgttttgactctgaaatgtgaaataatcctgcctaacccatagcagtggatgaattacatcactggagttgcgtgcaatggataggaactgcctggccacataacaattgttcaattcaccttagcagttattgccaggcaagggcatcttagcatcagattctgattccaaatctggttctcttctgctaacctcttacctcactttggaagtgaatgggaataggtaacatattaatttgtgaagtgtcctacactggtaaacattgaaggtaggttagtggcgtctttgctgttatcacatttgtttggaccctactctatgcatatacatttttttatcttgtagaattcattttagaatcaaaattttttatttaaataagacactttcataagaataaagcactttaaaggcagcttttgtcctcttcagaacctttgacagtctctggtttagttggctctaagtatcacttctgctgctacggagatgtcttcacatctcctagcaggatttctcagcaaatatcctaacagttattctccagtggttttaataccttaactaacagataggagtcaagttaaagtaatccagtatcagaagaagaaaaaaaaattttgcctgtacctggcaaattgtgagaagcataactgttaatgagtcctaatatttattatggttttgcctcttatcaaagttccctaaacattcaatgagttcttgttatccatatgtaaattttactttaaaaaatcccacaattaggggtcacttaaggttccaagttttccctctcacacacattttgctggtcatctagatattaagtacaaaccaaacaaagttgactttgctcaggccacattaaatgaacagggaagcagggagattcgtgtgatagacaccagagaggagcactctgttcaggcaacttggcaaaataattttggctgcaattgccctgtgagttgcggatgttttcggtagttttctttaacaccaccggaagacagtctttatctggaaacaataatggcaaaccaggcctcaggtgctaacacctgcctggaaagtaatagaatgaactggacataatctatttcagttattttctacttaaacaatgtacaactaaaatgcaatgtgactctaatattaactccggccccacttctttgggggattgtgggaattctgagcctggcgtacctgagggaaattccactataataatcatatttgggtcttcactttaaaactgactcctcagtgacttttaagaccaccgtgattgaagcctcaatcaccaggcttttttttttttaatgtttcccatcgaacatgtccctttacttccatatacttccaagattctgcctcccaaaggccctgacccatcttcagactgctttcttgttctctgcctgccccctcaatcttactgaggaagtttgcaggccagttggccagcttgaggcctggatgcagccttcacaccttggtggtatgttcaatatgtgtctcactcctctctgtgatctcttctctgaaagcacacagggctaggcctcctgccggcattgtcttccaccctgacagtctgcagaggcccctgccattccgcgttccacactgatccatgtcaggtttccccctcatgcagaggattctcagtctgactgcagatgcccaaaattcagatgaacaataaataacgctactagataaaatcaggatgccccgtcaaatttgaatttcagatttaaaatattttctaaattcttcacagtttaactaaaaaattattagacatttactcaaatatcaaatttacctgtatttttacttgctgattgtggca

SEQ ID NO: 24 - DNA, 2853 bp, Artificial Sequence
  Description of Artificial Sequence: Synthetic polynucleotide
gctgcacacagagcgcagaataaaggattttacatcatggtgcctgattaattttacaggtaactcttgcctaaagatcaatatagacacttgcaaacaagactagacaatctgtaagagagtcatatttgactgcagtattgtcaccataggaagagtaatagtgcttttggtctatattacagtcagagttgaaaggaccttaacaatgatcaagggtaaccccttcccctcatttttcagatggcaaaactgagagatttcaagagtttaaaatctttatttaaagcccaacagcttgctagtagcagagctgggataggaattcagatcccctgcctagaccttcaacttcatctcgtcccatctctctctcaccgccccagacacccttgtcctcattcagttctcctgaccagccaggcttggtcccacctcaggcttgggcacttgtttcctctacctggccccctctctactcctacggcttctcctggcaagtattacctcaattatgatcctttatagaggttctttctaaaatccagcaatcactgtctatcatatcactctgtttaattttcttctcaacatttatggatatctgaaattatcatctttattaactattatttctctattattttcatgccattcacaggtaaccttcaggatagctggggctttacctgtcttgttctctgctgtattttctgcttctagaatgatgtctggtacagtgtaggtgctccgtgaatactgttaaatgtataaaggaagaaaaagagagcttttaagagttgctctgtttatctgtatcttctgattatcctgtacttccatcgtaatgtagcacattaatactaactactatttattgaggatgtgctatattttcaaatgttatgttaggccttttacaaatcttacctcattgtcttcacaacaaccctaggtggaaggcataattacccctgttttactgatgcaaaagttgaggctgagagaatttgagtggctcaagcatctggcaaagccacatccagatccgtacttttccagcttgaaagtaatcatggctaagatttgcaacctcctgtgtttattatatctgttcccaggtgttcagtatcagggcaatatcagtaaaaacaattatagaacacttatcagattgtaagcgctcagaatgggtttaatttcacattaataatgaagcagtcagttggaagtacaaagatgctcataattgcattgatctgtgaatgttcaagagagcttggcatcctcacctgtttagggtttgatttattggttgtctctgctagggctcatgacaggagaggggacctagagtgttctgtgaaaagaaagctgttggctgtgggctgagagctcaggaggggccaatgtcaagtttggggttcagcctgcccttgtgcaggaggcctccacctgaaggagatggggttggggtttcttcattcaggcagtgaatcaggatcttaagaagaattgtaaacaggacccatagccctcatcttgttctctgtgctgatatgaatgactaactgccctcggctccccagtctgtaaatgtggagtgctatgtaaatgctgactgacaaccatgttggaaaatggtttcgtgtcatttggggctggcagccttttgtggcaggctattttcaaggctactgtaactttctgccttgattcttacatcttcactattatgggagaagggaggtgggacaccagaagaaggtcaaacagctgttcactacaagtctgaggatatttctagtctacccagagagcaccagacagagaaggttcaggagtggggtcactggtctagtcggatgattctaatcctggccctggtcacaggcattaggcacaggcctaatgtcctccatggacattgtcttctgcctcctgtcccaatgcctcagtcctttcaaatgcgttcctgccacccttcctgctagcctatcccctggagttctatcacaagagcccactttcatgactggagcttgcactttgtagactgctggggcatccctaagcagtgggttgcatgtgaaaaaaataaaactggatttgaaaataagttaatggcaaaaggaaagactactacttggacattagatgtaaagtggaaggggtgaaatgtttttctttagcaggctacctggcagcttcaggatagcaatatgggagaagaaagtagaccatgaggttttaatgagatgttgtggcttttatgagggaaaacagaaaaggcctgggaggaaagcaggatatgctcactgaggctgggggttcacctaagaggagtgtgtaggattggaaaagacagggggctggtttagggaatttcagctgccagaatcctggggtgccaggagagagcaggtgtctttcaaagtcaagggacagtcatggagctcagatgggaaaggactcagctgttttaacgtagatttccagtgatcagggctgggaaggattggcagattttaaggctggtaagcagagcacctgcaccttgaatgacaaatcagtcatgtggctcaaagaagcagcacaaacaaagcaagctgttcctagggctggctgagccattaccaaggtcagaggaagccttaactgggagcatggcacactgagctctgatgtggcaaacgacggaagtcacggtgaagtggtgtccaggctagggcgtgccatgtacacacaggcgtgggggatagggaaaaaagcagaggttcctaaatccagatgcctacaggaaagaaagggagtctacataagcctccagaggagcttgaacaataaatcaga

SEQ ID NO: 25 - DNA, 2764 bp, Artificial Sequence
  Description of Artificial Sequence: Synthetic polynucleotide
ggagaaaccttgtctctactgataatacaaaaattagccaggtgaggtggcaggcacctataatcccagctattcgggaggctgaggaaggagaattgcttgaacccctgaggtggaggttgcagtgagccaatattgcaccactgcattccagacttggcaacagagcgacactccacctcaacaaaaagaaagaaagagcgagattacgtctcaaaaaaggaaggaaggaaggacaatctcaaatgctatttcattatttttcttccccactcgtagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggagtgagtctctgatgaccatctagaccccacctctgaagagcaggggactctctggctctggggtccactcatcttatcttctgcatctataccctggggccatgtccaaaccccatctttcttctataccagctcctgagcatagtttgaagccagggcaatggagacttcctgaccttggcttaggggttcctgaagattcatagttctcccccttgtcagagaatctagggacactggctgatctcgaaaccctcacacacaggaactgacctcacacataggaacagttctcttctttcagcattttagcctcttctcaggcattttgagaggcaacttctagaatcagcatttgccaccttgttgaggtcacacccctgttccggacatgagggtggctctttctgaatttcctcttagcaagctttttcccctgcactgtcttcatcccgatattctgcatcacgctccagaatctcagacaggacatgagtagggatgcagctggtggaggtgacactaaacctgggtctgtccttcccagaggcacagtctgattctgcccagagtaagacattgacgggagctgggggcttcgtgctggggctcatcatctgtggagtgggcatcttcatgcacaggaggagcaagaaaggtgagaaagcctgcaaggtgagcgggacttaccttcccctggcatattcacacttactccatgatgagggttcagacagaaaagaaatgtcagaaagctctagagaccactgaaatcagatagtcggggaacaaacatgacctatggcgagagggggatcccaggctgggatcttaatgcagccagatgcatgaggtcccaggtgctcagactcctgcggggcatccattgagtggtggtcaatggaatttggtgggatggaaatgtttctctaactatctgaggtggtttcaatggctgaatacataacctttcctctttcatttcagttcaacgaggatctgcataaacaggtaatattcctgctttgatttccttggggggtgggttacaggaggatatgactcttttctgtgcattgtaatactgaggctcctccaggaagggaatctcaggcatgaacccctctttcaacctcggctctcgggtgagtggggaaaaagcattgcacggctccattgctgaaggaagcagagatcagttctgttctttatcagcctaagatgcagcctctcaccataatttttctctcctggacttaaaggaaggaggccagcaacctgggataacttgtcctttacccccacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgttctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacactttaaccattttctttgtgtgccatcacaaatactacttaaccaaatacggcttggacttttgaatgcatccagtagacgtcatttgtcgtctaagtctgcattcgtccaccagcctaggcctcctgtcttaattttcatacagacagagatgactccccactggggaaagagcaaagcaatacgtgtagcactctttttcaaacactggtctttttttttttttaacaatccaacat

SEQ ID NO: 26 - DNA, 2755 bp, Artificial Sequence
  Description of Artificial Sequence: Synthetic polynucleotide
cgtttcatctctttctcacatggctgttggtgtttgggagtagtttcaagttgtttgagaacgtgcttgcatcaacaaaattggcaatttgtttctgctcacagtgtaaagacaaagaataggaaattccagtgaggttaaggggagatctacctggcagactggttctcctggcctgtgacactgttatccaaagaatacttaattaggcaacacattcatactgacaggtgccacaatcctaaatgcgtagtccaagtggctaggctttagtgtcattttgtgtgcctcaaaaccttcacagctgagggaaatggaacttttctcattatttgtgacccaatttggcaatatcagttaagcaatcatgcctctgaatggcatggagtggggtaagcttctcccccagggggatttaggaactggaataattgattgtgctctgagtagctgtgcgctcagagattgttgagatgctaattaatgcacacatctgcaaccatcagttcagttttattcaacaaatacttgttttgtttaccctctgtgccagacaccatgttatgggctgaaaacccaaagctgaataaaatatagccttattcctcttctatgcagattttgttggagggggaagaattgttactagataattctaatgcagtgtggtaagttcagtaatagaaatgtattaaggtggcccacgacaagcgatacctgacccagtcaccaggaaataggggaagagatcatgaagggattcctggaggagaggccactggaaccaagtgtttaaaaaggcagtagggcttagaggaacagtgatgacaaagtctgggaagcctgaaagagcatgtagtgtgtggaacatcaagcagtttgaatttccagtggctaaagtggaagataaagagtgggggtgggtgtagagaagtaggcagagacagatcatggagatgcttgcatgccaccctaaagaggtagaacttgttcccacaggcagaggtggggtgacagagctttaaaagccatgaagtgagtgactagtctggtttaatttgggtttaaaagcctgggtagggttgatttgagaagggcgaggctggaggtggaggacaagagactttgcagtagtcccagagagaactgatgagagcctggggaagcgcagcaggcaggacaaaaaggggatgttgggtggacacaggaaattttccagagttgaagctcagggcaggggtctggctggggatggagatgtgtgcatcattaccatgtgggctgtagttaaggccaattagacaggattagtgtgctcacgtgaaacgtatgaagtaagaagaacaagaagctatgctgagtcagctggggataccacctctttgagaggataggggaagaaaatgccagcgaaggagactgcggggagaggaaagaggagactcagcaaagcgtggtgtgacacagccaggtgagcagagagttgaggacattttgacaatgatgttgaatcttcccatctggtaccacactgtgaaagctaagattaattaattcaacaaatatttacggagtaccaaagatgtatcacatatgtgctagttgacagtacctttaacttataattttaccaagattgacttccacataactagcaaaatgtaagctaccaaatatatttgttggattccattctgtcaagtatttctctgctcaacattgtttttagtttatttctacttctaattgtaagatatttttaaactgtacagtgaggcaaaaacttccatctgagcatggcattcagaagggtagtagcagagatgttgttgcctgctggtgaaataaatgcagtagaatgagaaaaacatttgttcattccattcctcaaaataagcaggctggatcgtatgggagactgagtgcttctcactgtttaacagaaaagattactctctgttcttcagctggaggaagtttatctctctctgtgcttctagttcccataatgtgaaaatgtttcacattctttcaacattgccatgcacaaacacacattagcactggctaagtatatgatatgggacactggaacctagttcacttaggtcaatctcctggtcagatgagtgaaatttgcttcttttaatcatctcctaatatggcaggaaaggtcccccaggctacatataagtagttacaaatgttatatgatttaaatagatattctaggttgtctttatctcttgttgtgcacaagccacaccctaaagtaaaagaaacagcacagatctgttgataatgagaccagtcattctttggtcaacagacatttgctgagcaacttgttaggcccatattgggagctggggtaacaaagatggattggttctactcacagccttcgaattattcatagactagtaaggtatttcatatatgttgaagttcttggtgaaagcccaagttatttctctttaccacctgtccctttggagtccttacattctaacgtgcagacaaaagtaagaagaaaagatggcttttgtgaaaagcacagcatctgttgtaggcagctgttgatctctgccatggcagtctcatttcagtaacttatcttcagctcccctctgacttccatttctcgcacagtttctggctctattttctgggttggaggggtgccctggaccattaggcatgagacattctctgctcctgccttgtcctcacagaagccttcactgggagaagt

SEQ ID NO: 27 - DNA, 2721 bp, Artificial Sequence
  Description of Artificial Sequence: Synthetic polynucleotide
tattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtcccttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgtcgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctttaaacatgcacatgcgtgtgtctttttcacataatg

SEQ ID NO: 28 - DNA, 2695 bp, Artificial Sequence
  Description of Artificial Sequence: Synthetic polynucleotide
gcgctctgtgtgcagcgcgaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaagagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattctgctgcacacagagcgc

SEQ ID NO: 29 - DNA, 2691 bp, Artificial Sequence
  Description of Artificial Sequence: Synthetic polynucleotide
gctggaggctggaagtccaagatcaaggtgccagcagggttggtttctggtgagggctcccttcctggcttgcagatggccacctgcttgctgtgttctaacctctgtgtgtacagagaaagagaggggtggaatgcaaatcaatgttctgatgtctcctccttttctttgaaggacacaagttctatcagattgggacctcagccttataacttagttcaaccttcattacctccttaaaggtgctatctccaaatattgccacattgggggttaggtcttcaacataggagttttgggagggacacaattcaattcatggcctcactatacaaatgtgggatggccgatgtccagggtacccctgaggagtgcgaagcacagcctgcccagggccggcccctctggggctgcaggcacatactcgcctgcatgtgcacacgcttgccacaactgcacttgcctcccaacctgcccttcggcagtcatctggggtctttctctccctagacccccggactcctggaatccaactcacctggtggggtgggggtgtcatagccaatcacactgcaggttacacacctgagggtgtgagaagtgtgagcctatggccttggtatccccaccatagacagctctggaaatgtcctgcgagcccgaccaggcagagccatggccacccatacaacagtcactctgcccaactcctggcagggtgcaataacttaaaaaggattttgatttatatgactgctgttctcatgatttaagcagcatcctatggataaaaccccacagccagcatcccagcctccacccccaactcgtctttactagagggaccctcccagcatcacctcacctggccggaggggaggccacctgtgggcccccaggcctagtgacagacaggccttcccatgtatgcagacactcctttgggccagggcggcatccttgcttcatcatgtaggctctgttgtggcggccccaggccccttccacttctcttgcagaaatcctatcctcttctccagaaggttcctcttctgtttgaggcccctgcctcccaggcggatgctgcccctggcaggaaggcatgctgcttggtgacacaggcaccaaggtgtggcccactagtttatctgagacaagggcatgacatggtcccaggtatggcccactggttaatctgagccatagtggatattctctccgtctgcgttacactcagggctccacgcgtttcaactctttctgtctatactcaagcagctgctttcctagaacctacggcaggaggtatgggaaggttgggagtttccagaatcacccacagacccatggccagccccagcagacccccccgacccgcagaccttgggctcctctttcccctaaggtgggtttccttccgaggcttcatgccagttcctggaagctggctttgagcacagccaccttagtcaatcaggcatgtttttgcctcatcaaaagcctttggagaagggtcaggctcctatgccctttcttccctgagtaacatcagggagcaggtgtgtatcttggagaagaggcacagctcctccacctggctgcattcaaatcccagcaggaatgactgtgacaggcagcagtgacacccaagtcctccccaaccgcacccagcccaggcccttccacagtggcctgtcacatttaccacattctggaagaataaacttggtaggtctccttcatttattcaacaaacttgctttgtaaaggctgtccgtgctcagcactctgggtatgagatggaaaatacccagttcctcctctcagagaactcacagcctgcaaggggagacaaaagagtgaactggtaattacagcacatgaggctgctgctgggcttcctgagggagtcaaggagggcttcctggaggaggacacttttaagctgattctaaaatttttttttgttttattttggcataatctcaggcttaaagaaaagtcacaagaataacaagaaaaatttcatacagcctcatctaaattccccaaatactaacatttaaccacatttgccatatccttctctctctctctacctaactacaactaaatacatcaactaacaacaaaaatattcctttacataatcatggtacaatgatcacaatcaggaaataaacattgatataatattattatctaatctgtggacttcattcagatttctccactggctccaatcatgtccctcaaagcaaatgcaaatccaggaccacatatcccatctctgtagtattctttaacctggaagagttatgcagcctgtctttgcattttgtgacattctcacccttgtagagtataggccagttattttgtagaaggttccctgatctgagcttagtgatgtctccccagagttctatccaggtgatgtcaggaaccccgcacaagggaggtacgtcctcctcagcacatctcataagggggcatgggcatccatttgtcctgctgagggtaatgttcattctgataacttggttaagatggtatcctccagagttttccactataaagttactgtttcccccttgaaattttttttttttttttttttgagacagagtctcactctgtcacttaggctggagtgcagtggcgcgatctcagctgcgctctgtgtgcagc

SEQ ID NO: 30 - DNA, 2671 bp, Artificial Sequence
  Description of Artificial Sequence: Synthetic polynucleotide
gcgctctgtgtgcagcgcatgcttaaagggttggatacccactctccgtgatgtgattagttcatgtttcatgcctgtatcaaaacatctcatgcaccccataatatatatgcctattatatactcacaaaaatgcttgaaaataaaaataaaggaactactgaaggtcaggtcagagtggaaatgcaaaagtaccaattagagaataatgtgaatacaacaggaatcctgttggtattctatttatattgtaagcagcagttcaattgtcttgtaaaagcaatttcaattttaatcactgaactaaagaaatgggcaacactgacttccgtaatataggttctacctaaccatctctaacaccgctgtcaaggaggtccagtgttaaggtacattattgttataaatattagtgagcccatacttctgcgatataattaaaccaacttaatgattctcacataaggtgtcaatttattttactaatgcattcataatctatgctttgtagcaacatttttcaaatgtttaaaatgctaaatcttctcaattttccaatcttttcttgaatctattagatacctatagtgtagttactgaatagctgggaaacaaatacacctagttagaaatggcactgctttataaaaggcactagagaaaagatgagactatttctatatttaaatgctgctggcaaatgaattcctttgtatataaatgaaagataccattcattaaaatgaaagacttaagtgtgattcttacatttcattcatttatgatagagtaaatgcctttataattactttaaaatttaactcactagtacattaaatctgttcattgcaagattagaatcaaatgtgaggggaactaatttaaaaaagcccttcgttagtcttattgagtctcatatttgctgaaagtacctacagcttgcaggataagggagttcacggactatagggtgagtgaacccatgcacagattgcaaactgcccagagctacaacatttaggatttttagacctttaattttccaagtcatagaaatctgttacaggttcatcacatctttgtctaaatggcaactgaatttctttaaagataggttaaaaaaggcataaaactatgaattattatccgtttgcgtgcctctatttttgctttagaattatggaagtggatcctgtgaattagggaaacactgttatgtatacacatgggtgaaaaacaatctaacattatgtaaattaaaatactttttttgaagttgaaaaacatccatttgttctaaatctatatatattatgtgtatctagtacagaataaactgtaacttgtcattgagtaatcttaggttttacagatatgtaaagctaaagcaactctaaagagtagacatttcagaaaaggaagattctggtcaatgttgagagtagacactttcactgaaggttctggtgaaatgtgggtaactaattgcttgaaatctataatttgctatatagttaactattaagttaaaatgttatttaccatgctttttacactaaaagctttaacttttctgagaaaataatattttaaatgttcaattattacttctgaggacagctacttctagcattctttgtcatgatgtgcttgtgtgcagtaagcagagcattttcagccacttacctctacattcttcctgtttttcaatttctgatttagattataaaaggcaaatgattaatttaatttgatactcagagttgtgtttacctttcatggacaaatatatgtcagatactttgatgtttattgatatgacaccgtgtggttaaacaacgcaagtatgtccacgtgtttcttatagggtacacttgaaactagtggtgtttatgcagttcacttatgtaacttgaaaatcttgtactattgcattcaggactgaaatcttggagtttatgtgtcttgcctctcattttgaaaataagtgaaagttgagaatgtaaaatcaataaagttcatttttttaactaggaaaaaaacacaaattaatgacagacaccaaattacaaatccaaaaagctcacagaacaccaagcagaatgaatattttaaaaatatacctaggaatatcatattcaaactggagaaaacctgtaacaaagataaaagattaaaataaggcagaggaagaaacacattgtctacagagaaacagacataaggattacattggacttctgtttagaatccatgcaagtaagaagtgttgaaaaaattagaatacagtgggtatttattatccaagtattcattatctaaaactgcaaagcaaaaataattgtaacaagaacacattcactagcaatctgaacactcatggtattagtgtctgttctggagagaattatgtccccccagaattcctaacctgaagccctatctcccagtgtgactgtatttggagaaggagcttttaagaaggtaaaggttaaataggggcaaaagggtaaggccctaatctgttaggactggggtcatcatccaaaaaggtagagacacaagagatatatatctctctctcttctctctctctctctgccccactccttctctctccctccctctctccctctctctctccctctctctctggcgctctgtgtgcagc

SEQ ID NO: 31 - DNA, 2664 bp, Artificial Sequence
  Description of Artificial Sequence: Synthetic polynucleotide
cttccgatctgcgctctgtgtgcagctgtaagttttcctcaaaagaaagggtatggttgttttttcgtttgcttgtttgtttttgttttttgtttttttttcgcccaaaagctactgtgtggcagacagagcttgggtttggaaatacctggctttgaacctaaaattcacagtttgctaaagttatatcaccttagcaactgtctgatagtattatttgcatggatatctaaactcaagattgctgacagggttttgtgagatataaatgtttcttatataaaactgaggtagctaggatgggaaagttgaagagaggtaagatatgttaccccttttataacacagtgtttcacaattctggttccagaagaagagagcctaggttcaactccccgctctcccactttcatcttgaggatgctacctaatctctcagtgcctgttttcttatttgtaaaagaaagatgataatagaacttacttcatagagttgctgtgaggtttttatatataataaatatatgtaacatatataactctatatagagagagaaatttatgctggtttttatctcatatatttctacaaatcttcagaacaattctgcaaacgattttccacattttacatacgagggtcgacaaacttaagcagtttgtccaaagtcatactggctagtaggctaataagtatcacagtgaattgtagaggcacctctctttggcattgcgtctcagaatatgagtcacaggactatatataacctcataagcctcaagcctataagggatgatactggtaatataatccagttattttctgattcttgcatagcctctttagcaattcaacaaatagttatctaatctgtatttgaagagtacattcttttggaggtgagacattctgcctttctatagcccctgactcttagctcttcaaagatcttctagggctctacctgttcagatactcccacacccttggtggtggcttctgaaaacattgaatgaagcacagtttgaaaataatcatcctatagtttgtttgcctctatgaccctatctccctgtagaacttggcaaggtcacctaagatggagagaactagttaacagaaatcacattgttatatgtcagaagtagcgtgatggcaaatctgttccagtttggcgggatgtgctcttttcccaaaggattccttcccagacacttagcattacatgtttagtttatgtatattcagtagttcattcatcagtcatattttaagcctttactatgtgccagggtgtgttaagtgctagagatactgacaagagtaagattacatcacagtttccaggaaaactcaaagtgtggatggggaccatacataggccaacagataattacaatagttataagatggtgcaataattctatattatatgtgagtccaggatcctatggggatggatacaaagatttcatcccagtttggaagtgtcagcaaatgtgtctcagtgaaggagatgcctgtgttgtgctaaggatgattcggaggtaaaaaaagaaggagagagaggggtcctctggcagtcgaggactgtgtgcctctgcaagcttcccttaaccatggtttttaactttcccttggctgagtgtttttccacgagattaagaggcagacaaaacagcaacaataggtgccctatgacatcatgggattaaatcataaatatggcttggggtggctcagatctcctcacatgttaatgtgctagaggtagaagtagaggcaaattaaccatgaagtagaagaggtattttaggaattgtatccttatttttggtttcagtttgtggctcagtctccaaaaagtgaatctaagttattacaagcaattaaaaacatggcgttaatgattcatgtattttcatttttttatttgaaatgcctcttaggatttttcctccctctctattcccgctattatcacactaaattaggctcttatcacttgacacttagtgtacagttgttggctcccaacttactttctttgttccctgtttttctcttctcttgctaatctgttatctctctaccatttccctaaaattccatttttacaagatcatttcccttatcgaggatgtacagtggctccctactatccaatttattaatcacttttatttatctcttgattggcttttagatcatccataatttgcctatactgggcttctccagccttagttttaacttagtactaaatatctcttactaagtttcaactatagtcaaactagtctccctgccttcgtgcattattccataaatacttgctaaaatattgtgtataaaactgtgaccaaaagagacatgagacctctcatcatggtacacagagtcgattggagaatacaagtgttaatagaataacacattaagaaaaagtacagggacataaattagtcttttactaccttttcacaatatatgtatgcatgcatgtatgtatatgcacgtgcagacatacacacatacttctgttgttttcatatctttccatatgctaaatctgttacaagggattacttccttcttttactaccttataagtagagcttctcctgaactacctttatctattactaatgtgtcatgcatgc

SEQ ID NO: 32 - DNA, 2649 bp, Artificial Sequence
  Description of Artificial Sequence: Synthetic polynucleotide
gaagcccctataaaaagtcagatactgtgtagaaatcaaaattacttaatggggttacaaattcaaatgtccaacaagtgccaggagggaaatgtgaatgacacagcagcccagtaagacaatagagagtggtggaggctaccgagaactgaagactaccacccccagttgaagggggaaactgctgctcagctccactcaacggtagcaatcccaggaatgtggggcctgtgttgacaggtcttcaaatattttaaccaaaaaatcattgtacaatggtcactatgtttaggggagaattggagagtagggggaatatctcttgatttttaaaagctgtcaagtatcagaaaagttttaaacatgctgcaaagccaagtaaaatatgcctgcagtcgcaggcagaaagcaatccaagggccccagtgggtgacctctggatgtcgcagagtctcagcctttttggggcttatgtgttggaagataagacatgttcataaataactacaatacagaacatggtgataagtgttgtgtgagcaagataaagtgctaaaagaattaagaggagggagagattactgaacagtgggttcctaaggagagagaaggggtgtctcagaaagctatttctgactgcatgttgaggaacccaataaactcaaggagggaggaaaaaaagagatatccaatgatctcagtaagccggccaggaaataattgatgcagccgggactgggcatcagcatatcacagggagcatttccaagatgcacatctagctcttacccctgacatcctacatagaaattccttgggttgaagatcatgcacccaagttttaaaatgtctttttagttaattctttttcaggcccttcattaacttctgctctaaggagctgtcccctaaaacactgtctaaaacaacaggtatgtctcttttgtcctttctgtatccccaaattcaaataaactaggatgcacaggttgtcaagtttttattttgtgagtgtatcatctgtgcctgtacctgggattccatcctgagccaggcaagagccttagtaaggcactgccttagcctggaggagaacacaccttcttgtacttatccatttggagcaggtgccattttgttattcccaaaaaggcactctatgctacagtggcctgcagattaccaaggaattgatagatttccaagccatctttctccaaagattaccttaaaaaaatataatccttatgttgacacgagttgtatataaaaagttggcacaagtatatattgaatttgcttagaactaaggatgggattgatatccaatacagttataaaaatccagaagttcacgtatgcttttccaatttataactcaaaattctcatcagaacctttccatacgtgccttagttttcagcttctttcaggaatacccaggctcagttttccatcaaagacacccagaaagcaggccccattgtttcactattattgttgccaaatctgccacctctctcatcactggccatcccccctgaagggttgcttacctaaacaccaatctaacctaacaaatcttacttcaaattgtgcactgtcctaaagaagacatgcgaggaatgcagtgttctctggttgttgaaacatatgcatttcaaaatcaaggaagccttcagtatgcagaagttgttagctttcttggccccttcctcttttgagctacaaccattctcttccattctacattccggtaaaaatgcaagttgtccatgccttctaagcttgtgaagtaaaagaagatgtggataatgggaaagccttagtatcacgaaaatgaatgactccataaagttccagtggaggtaattaaaatgagaaatgtttgcattttgtgaactacatgtgctgcccaaaataaaattaggggtacactcttgaatcctgcaagaggaactgatcccaggaaacttcttacagtcagtagggtggaaactgcccattcagcttggttatgggcttgtgcactcgaaaaggggagatagtgagccctttaagcaataataccttatgttgtgtgcattttgtagttcagaaacatttttacatccacttcatcatttgattctcacagcagtcttaagagagaggcagagaaggattattattataaccaatctacaaagaaactgggacctacagggatgtgtagtggatatgtgatgctgttgctgccaaatgcccctttacccagctgccaaatgcccctttacccttctccaagttcacgtctggggaacatctgctcttgttttgagtccatgtgcttatagaagatgtaacaacataattgattactctaaggatggggcatgtgaatcagagccttaaactctttaggtctcacaaatttcttcagggatgggcccatagacttggttagagctaacgagatgcaagacttttatttgttggtagagtgatgtgcccactttccttcttaccctcacgtgatgtcttggaataaagtaaacatataggataatagaactagtagaaagagaaaggcttggttcagatgaaatcattgattttcccatcttggagcaattacatttccttttttatttttatttatttatatat

SEQ ID NO: 33 - DNA, 2585 bp, Artificial Sequence
  Description of Artificial Sequence: Synthetic polynucleotide
cacccgtaaaagcaggagacaagaaaagtggttacaagaaaggacaaagggacgacaatggggccacccatgctgaggagtttctgtctcattcgatgcaccaggagaactgatggtaggattcgggggtggggagagacagaattcacagtaccagtaggagaaacagcctcaagaatgttgaaagtggagtctgaagtcaagaaataatggaaggctccctcacctcaagatttgctgaggtataactggtatacaaaaaaccacacaaaattaatgtctacaatttggtgagtttggatatatgtatgcattcatgctaccatcaccacaaccagaataataaacatattcatcatctccaaaagcttccatgtggacctttagggttttatttgtttttgttttgtggtatgaatgcttaacatgagaagtactgtcttaacaaatttctagatgcacaatatcatattgttaactgtaggcaatatgttgtacagcagatctctgggacttattcatcttatataactaaatttatacccattcaaaacaactcctcacagagggaatctttacaagattagaggcactggggatgcagaataatgaatggggaaacagaagtcagttgccatttaaaattggggaaggaggtatgagctagggagaaggacaagtctaagctgactttctggtttctagccagatggtgatgctatttaaagaacggtggaggctgactatagtggggcaagggtagacactaaaaatttagcttctgactggcttagttttgaagtggatcaaccgagagagctccatacaaatatggagccctacagagaagcctgggttggagaaacaggtgggcagttaacatcaaatctgcagaaatttaaaataatgggaatgagtacaactaccccaagtgtgcaggtgaaaacccagtatagaatacctggaaaagatttatgtttaaaaggatacaaagatgaactagaaaacaaggagtcagaaaaataaagattgaactggaacaatgaagagttagaaaatccaaagacttaaaggtggagcaaaagtggtcagtggcatcaaatgtcacagagaaataagtaaaaaaaacagaaacgcttctacaatatgcttcagatgagaggtcagtgctccagagctgttgttgtggagaagacaagaaacagaagctagactgtgggaggctaaggcagaagaggaaacaaattttttatgtcctctttctaaaggctgagttctgaatggaagttgagagaaagggactgccagatggaaacagaggtgtgacttggccatcagtaggctgaagggaatgtgcttggaccagaaagaggcttatcgtgtattaataataggaaagaattagaaataaactctaggagaactgttttatccatataatggaataatgtgcagactctaaagatgatagaaggctgttcataatatcagacatacaaatacacaaatgcatcaatgacattacatcatatcaatattatatatcatactatgatgtcacctgaagcataatttgtgggggctacttgggatacataggtgtgttgatcttagggcaggccagttagggttacagatgatgttcctgctttttgtaatctctgattttctaaaattcttatgtttaatatatgtaataatacacttttaaaggaatcaaccccctaagtagaataaacagaagttcaataataggccagaatttcgggacaagagaagggatggcatccatagcactcagaggtagaaggagatcctaatttactaatttgcaagggaatagggacatctctacattgcaataaaactgtgcagcaatttagaaattctccaaatcagtaatatatgtagaatgagtgaaaattttcattgttaaactatttagacatttacaaaaattttcatatgtgtgccattaagtgtttttgcagtaatctcaaaacatggaaacagacagctataaggctggagaatttggagtcagggggagtactgtaagggagagggggaaaaaagaaaacaaaactttaaacagcccggtatattttagtcaatgttcctaaatgccactgtgaaacaaagccacttcagtttctactacctgaaactaaaacacacattaccctggtcaaatgcttgggtaaatgcttgttttcaccgtgaatagtccccatattgttcagcatatcacctcctggattccttaatattttttttcccatcaaatggtctaagccacaattagagggaacagttccaatgtcaaattcttaacaattctcttatccttccaaattctgggaaagatcataggtcttataagcatgtgcccagcccttttactccccagcatcaataaacaacttggtctgtctcttaaggaaagactgtactttgcctcacagctaatttaccaactatcccagaacagacaatccagctaccaaataaccagtgctctctttacccagatgttgaaggtactctttcttatgcccacaacccccacccaacttttttctctt

SEQ ID NO: 34 - DNA, 2565 bp, Artificial Sequence
  Description of Artificial Sequence: Synthetic polynucleotide
gcgctctgtgtgcagccccacaaacatctacccggcaagcaaaggaaggctgacagtgtaatggagggtgaaatgataatgtcctctttcgtaaatggaatccagccgatgataacaatgcactcacacagatttgcagggcgttctggatggcgtttcaaatatcccattcccctgcactttaagaacctgcagttgggtcgccctctacacaggagacaagtgaccattttaaacagactgagggaaaacctacaccatattactagagcaattatgtcagggcagaaacagaaggaggtgatggaggaaaaaagaataagaattcaacgaggcaaaattcgcagaacacacttaggattgggagagacaattcaagggaatgcaaatgaaaattagccagctaggaatctcctattatttagaagcctcaaactgttggtaactgtgtaaacattatgccctgtttggtagacattctggtaggtgcctgtgtgtataccctttggtgcataaatttcacttctagattttattcaatagaagcacacccaaccttgcaaaaatatatgcattccattcagtgcactgtacgcactgcactcactgcagcacttctgagtaacaaatgtgatggaatgctctgttattcaaatacatttgattgaaataagagttgctgaatattctgtaaaatatgaatccatttttgcgaaaagactgtgtgctcatatacacagaaacatttagaatatgtgccaaataaaagagaaatgagaacattactgaattgcttaaaattattacatacattgcctacattaaaaagcaatgaacctataaacattactattaattaatggttcttttatgaccttggccttctaatataaattcactaacatatctgatccattctcttatccattagagtaacaaagttcatgattttactataaaggcttcaaataaagaagttcagagtgtctttctagttgttgaaataattatgtaaatagtgttgaagctgattatttatgttgaaaatgaacaaacagatgcacagtgagggttaatgggatctttaatgggtttctttatataaagggacaatttggggtaaaaaaaatttttttcttaactcttctataataactggcatgcctacttttaattatcttagtcaccctctcttctttattgagttgacactgtttgtatatcttaatgaacttacatagattatttcaatcgattggttttgttaacagaacaataaatcctgactgataaagaatgcaggatgtaattagttagctcttcttattacgtgaatttctgatacttctgtaatgagtaattaaagattaataagaaagatagtctcatattagctgcttcttatctataaatgcttcaggatgtgtggggatcaagccacacttgcattctcaccactaggctggcaactagagtaacttggcagcaaacccaaagttctaactatctgaaagtcttcttccaaagaactatgcctcaaggccatataatttcatgataagatggctgagtggatcaactatatcctcttcacttctgctcaggaaagggtgcaaggtgaagccggacaatgtctgagccttcaccgtgccaccttttctggctgtgtaactcaaaaagtcacttctgcggcttcatgcctctgtctccatgccacatagcacagagctggggtgaggattcagtgagataatccacacaggacacttagcaactgacttgcacacagtgagtggaaggcagctgtggttattattcattcaacaaatatttaaactcctgctatttgccaagcactgcctaggtgctggggatacatccatgaatgaacaagactaacccctgctcccaaggaatttagtattctctttcttttccctttcgtctttaggatttcttaaaatcagaaacttttgttctgagagtctgatcagaagaggcctgtataggcaggatactaattcaggcaatcccctcggccaccatgtcacttagaggcccaggccctctgcctggagaacacaagtgggtgtcacgcctatgcagaaggcagcccagtcataaggctccatccatgacaacatactctccttgcgggtttaggggagccatgcagaccacagcaacagcattctcggagcaccctcttcttttgtatcccaccactggctaaggagccctgtgcaccagcttgactctggtgcatcaactcagatgatcccagcagcaaccctgtgggcaaggtgagcacacctacttcacagctgaggtagctgatgcccagactaaagtaattagcccaagacacacagcatatgtggtgaatgggattcaaaacagcccaactccaaaacccaggctctgcgcccatcaccatgctgcctccattgtccatagcaactactccacctcccaaatagatgtgatgtgtgttattttcatgcaaaagagtaagtgtccaccacacacacacacacacacacacacacacacacacacacacac

SEQ ID NO: 35 - DNA, 2548 bp, Artificial Sequence
  Description of Artificial Sequence: Synthetic polynucleotide
ttgctcttagaccttcttcttggaaggatgtctattgctaaaattaagcaacagtataacctcatcagtgatgttctggctctgataagaaaaaatgactaaatctctaaggcagctgtaaggtttagctggtatgtaccagcaggagtcagaatacaatcaaattaggaacacatttctggatacatgacttaaaattctgtaaagggccacatgagactgtgcaaagttgccactacaatggctcctagatgtattgtaaaagttatatctaatactaaatatagttagtacatcagaattattgtgacagaccatagaagaagtatttaaaatgcccagagaaataaacaagatagaatagatacgttatctattctgacatatacatatacaacaaataattatgtaaaactgacatatacaacaaataattatgctctgttagaagaaacgggatacgtgtctcactaagacaaaaaggaatgcactggaaagaaaacacagtatctgtcttccatagataaggaatgataatataggaaattattaaggacataagcttgatgatggctatgaaggtattgattttactcttaatggaaggtaatactttggtctgccaaaatttcatggatactagcgaaggacgagattctcctggatcagagacaaatttgtacttacagcaatagccatagtcagagtaatattaaagttactggcaagcagaagcaaggtggctttttgtgtggaagaaaatatgacctgatttttcagaactagtagctgcataaacaatcctaagaaaagtgacaaatccaacagtatgtgtaggagtgcaagggacccatgctggactctatccaaataatcagtgtgcatggcagggctccaaaataatagagtccaggtggatgcaattactgtaataagtggcaagtagcaaggtcagaccatcacagggagacctgatcctcagagatttataacaacagttaagagctggccaagatggatagcctcattcctcctaggtccttcctcttgctactaaaatatactgagccaaaacaacaaacaagcataggaaaaactggaaaagttggaaagaagttggcagcctactaaaagaccttgtgctttgaggaatgactcagcagtgggtccttggtttccttactggctttcatatatctcagacaggacgttgcagaagtctacaagccagaaacaccaacaggcaatgacaaataaaagtacacacacaaaaaacctgactttgtagccataggactgagaaaaaaattggcctaaaaaaacaggaaacatttttcataatacaaactatactccaaacaacctcagaaaaccattctcttcatgcccccataatttcagctgtgatgaatggggagttgttcattcactccaccttgcctacatccaattaatgattcagaggttagatttatctaactaagatttggaatcagtcatcacaaaattgctttagcaagaatgatgaatctgttgaatcaaataaaaaaagaaaaaaatgtgataaagatataaaagttacagaaaataactatatgcaaattatagagctaaacaatgcaatgacaaaaaaaaaacaaaacatctggatggacttaatagtagagtggagataacagtacagactctgtgaactagaggtcagatcaatttaatttatcaaatctgagtaatacagaagtaaatagactaaaaaaaaagtacagaatctcggagaaagaatgtgggtctgagaaaatattcaaaggaaatgtggatgaaaactccccaagtctagtgaaagacataaatctacagatttaagaatctgaatctcaaataagataaacctaaaaaaaatgctaagacacatgataattaactctcaaaaaactaattataaagaaaaatcttggaagcattcatagagaaatgacaaattatagagaaaaaaatttctaaaacagtagatttttcctctgaaacaatgtaggtaaaaaagaaatagcatcacatgtttcaagcactaaaagaatcatcaagggcaagttctatatgtgacaaaactatccgtcagatataaagacaaaataaaacatcaccggatgaaggaaaactaagacaaattttcactaaccttaaaaaaacagctaaatgaagttcttggaacttcagaaaagaaagaacattgaaattaatagaaataaaggtaaatgtaatacactattcttataaatttattgaattacatcagtttgttgaagtaaaaattataaaatacattgtgtacagtacatgacaagcgaattcttaattataacacaaattggggagggtaaatggatataattagaagatttttacattaattctacttggagagaaagcagcaatatcagtagactgtgttaaaatgcttatgcatattttaatacttagaacaactatgaagaaaaccatataaagcaataacttaaaaatgcactatacataaatcaagggcgctctg

SEQ ID NO: 36 - DNA, 2548 bp, Artificial Sequence
  Description of Artificial Sequence: Synthetic polynucleotide
gcgctctgtgtgcagcgtttggggatgttaccagcatcttcatttacaggctgagaatttttgttgtaaccagcaagaattatgcccaactgccatgatcagtctgtttttattatttagttttataagaaataagcgtcaatatcttagagttacgtgacataaataggactatgtaccttcatattttggtaaaaattagataaaatattcagtaaacatttattcgataccttgtatctgcactcagtttcttgggaaggattaaaagaacttgaaggaagagtacttgtcctccaagatctttgcatgtagctgaagagataaaacatgtgactttttatagagaggttgaactgaataataattggaggccaactgacccatcttcctgttgacttctgtttatcccccagatttcattcagagattcctctctcagctcttcttgctttccctgttttttctcttcccctcctcttgaatttaaaatcatagtatctgaaagtaattatagtcaaaaatctcaacagagataacgctgtaggacaggggcccaatctttgggggcagaagagtgtttaaagaaaggttttaggttttcaattataattcttaataattatgacaaggttcgtcttttgaaataattattcagcatttaattgcttaatagacattctaagcacttgaacctgcattacatttaattctcacagtaatgtttattattcccgttttatacctgaaactcagagagctttagtctaagttgtttagtgacacagctagaaaacagcagcctggatacaaatagagatctgatgccaaatttgatcctctttacattatatgacagtcttttcaacttgctgtgccaagatttgatctttccacacagtagcacatagcagttacagcgccttcctctcaaaaattatattttaaaagtaaagatcagaggctattcatcttgccttaacccttcctcctttgcaggaatcctaaaatggctagagcaagttaaccataggtgagcattgagtaaagatcaccatttaggaggtaatccttatggtagggttacctctgttactatctgcagagacaaaacagatactgaggtatttatgaactgtgcggttcccaggactgatgattttcatgattacttatgttgcaaaacataagtttaaagataagccatcattaatgctatcttactttttagacaatcgggagaagatagcaagatgctagtgtgtgatacgtgtgacaaagggtatcatactttttgtcttcaacgaattatgaaatctgtaccaaccaatggctggaaatgcaaagtaagttgtttacttttttaaatcctctgtatgttttatatggagaacagacaaatcggatatctattcaaatctatacattaccatcagctttttaaaaacagctttattgacatataactgacatacagtaaactgtacactctccaagataatgaacatagtcatcaccgtcaaagtttcctggtgcctcttggcttgctttgtggctgttcaaacccaaaccctctgtcttcctagtctgctttttcactatagattagtattcacttcctagaatttttaataaaagcttcatatagtatatactcgtttttggtctggcttctttaactcagtgtaattattttgaaatgcatccctattgctgcacagatcagtagtgattcttttgtattacagagtgctggagataccacaatttgtgtattgaatcacctgttggtgaacatttgggtccttcaaaattttgagctattataaaaaatgccgatgaactcattaactaacttcctacctcacttggcttctgccccttcagggtgaggcgttcagagccgggttgggggcagtggggtagtggacatagccctttggaatccaaggtgcggtttagcttttaagcttagtcttcctgggctgctggtgtcgcgaggttgagggatggagatgaccctcaggtgctgcatgggcctggagcgggttctccctggagctggagagggcgtgatggcccgtgtgcgggagtggaaggcacagcattgtcattgcccttctcggaactgctttttctagggaggaggtggagggcctgggaaaggagggtgatgtggccagaaccccaggtccctggcgtggggaggaggtgggagcagacgcagagagattctgtacctgcaccctgtcctcgccagtgaggtttggcacctagaactgcaagcagtattaccaggttctgttgtcctcttcagcaagttctactagacatctgcctgagtggtgggggttgaggggaggggctttctctcctggggggaaaaagagctgctgggtaactgtgctcagctgtggctacctgggaagtgggacctgagggctgaaggattgtgatgaactctggccttcttcctcaggttgttcagattccttctcttgctgaatgacatcattggaaaggaaaaactctgctgtttgactaattt

SEQ ID NO: 37 - DNA, 2529 bp, Artificial Sequence
  Description of Artificial Sequence: Synthetic polynucleotide
aggatttcttaaacaggagtctgaggattgcttcaagggggagaggggcagagattgttttttttttttttttaaagaagcagattctcaaagggcttcattcatgtcctcccaaatattgaggactcactctttagtaggaattccatgaataaaggaataacatatgacatctgaagtggagttgtcccttattatcctgtttgttttcaaggtagcctcacaaattcaaatggcgtcccctgcacccttcaaactcgccctggcattcagaacgctgctattctctgcttggaagggtcctcgcctggcacagcaaactcccatgtttaccagaatccgactcaaatctcacctctgggtggtgcctccttagacccctgggaagacctgggtaccctcctctaagcctgcccagcaccctctctgtctctaacacctgtctccctgtcctgtagtgacttgctcacctgtcactatgttggaacaccttgctgtattcattttcccatccccagcattgatctctgtgccaggttcacagaaggtgtccaggagatcgctgtgtgattgacagtctggaagctgggctattaagggcagttgtccagccaaatctgagtgaaactgggtcaggatttaaagatgtggttagtctgattcacatagactctgtaaatgtcactgaagattatcactggcatttggatggtgtggtctctgtgaccacagggcagaaaattcaattattcagcacttgctgtatgcaaagcactctacggaatcccatgagtaggaggaagtctcaaagaggatgaagacattgccccttcttccaggagatgtttaagttctatttgattgggtcaagctcatataaaattcaaggttttgaggcttggtctcatgatcagactagccagcttgggccagaagtgttttgcgcttggatactctcacaggtacacttcatattctcaaactaaacatctggtaacacagagcagttggcaagataatcaggtttctttttgtaggtcttcggaaggagaacaattggatagtatgaggggatcatttgccaattatagatagtagccctggaaagcactggagagacctgggccctaacacggtggaaaagttcagaaattcatcgacgggagcggaagttagacacattttaatttcacgtgctgtcttgaatactgtgtaccacggcagcgtctttactcgagactcaaaatcatttgactcttctacaaactggattcccattcaagattttctcattctcctctactgtggatattagcttggaatagatcattagcgtccatatagaatttgaaatctttatttgaagttataaccgctaaaaatgattgttaaaatcatggtgtgtagattcagatatgaggttcccagatagcaaatttaagccttctctaaccacaccccttaaagggcctctgcggacacctccacccccttgtgagacccaggagtctcttccagagtgcagtagcagaggagtggcttccccggggaacaaatactgcgtggtgcaccgtggtcccgaccagacacgctggccctcctggaggcctcaggcattacttagaccttcagccaagtctctcttctgtttggagagcttgggaaagcagttttcatctcctaatggaaaatgaaaatctgtcatcacctttcacatcatcagcctcctggagccccctagtccgtctgactgcagttatgtcccagataatgaggcttcaagcaagccccctaagtgcacagcgctgcaggctcagccctctctgcactcctctttcttccccgccttcctctcttctggatctggatccccccacacctgctcagtcaccaacagcaacctgccgggtatcagctaccccactctggggtggcggtggctcgggtgaggacagggctgtgcctgcaaatggccccctcgggcctttctccctgtcccatcgctccctgcttctttcacaaaagtcaacatcacagcctgtaacccaaaggctgataggatgtgcggataacagctatataaccttaattctcaaacgatgggagacagccagggaatttcgtgtcagctatccactgctgtggctccgtggaaatgcttccagcacaaacaacctgtgtacactgcagaacctttcactcaggagggaggtctgagcacggctagtttttgctgcctcggaaggggtcagggctccctctgcagggagcccgtggttctgccgcagcagcggagcctccagcgccagtcggtgaccctcctgcccatgcctgggaggatgtgagctctggtgccccaggcagcctggaattgtgccctgggagtggggctggggcaagggagaggctgcagtgtcattacagggatgtcctcctttcctggaggtcactttgggcttgaccacgggctgtccactgcctggcgtggtctctgatttgctgctctctgcggacccttggttgtgctct

SEQ ID NO: 38 - DNA, 2495 bp, Artificial Sequence
  Description of Artificial Sequence: Synthetic polynucleotide
gcatcccaagaggttgaggtaaggaaaatatgtaaagacaaaaagaagtctatgcaagctgttttgaaacaaacatcactggtcacagggcctgatgcaggagctggtgttaacttactggcagaaacagccattgctaggcaagtgttcttgtgagggtggcttatctgaaatgctgcagtcttgaggaattttttatgataggtcctattatagagacacctacaggatgagctggacaaacaagagtgtgctgggtgggcagaaatttcttgtgagtttatagaaagtccttgtgatagtgcttatcgtggacacacacacaagatcccctttttcatgacccggctccactttgctttgggtctgatgtaagtgactttgccttgtcattggcaactttcactgtagtataatctgcacattaaagttacctaacaatagtacaaagaaagaaaattaaaggtatatctctttcaaaaatataaaccccaaaattgttaggaaattgtagtgagtataaaagataattcattataatagacatctcaagcttcacagaattctgacctttgctacactctcatccacaatcttttctcctagtaaatggcagctccttctgttaagttgctgaggcttcttattgcttttttcttcaaataacagtcagaactgaacaactgtaatcatcctagtccatacaattgttatattttcatttaaagaagatcaatgtgtgattcttttttatatatttctggacaattctttatattttaatagtagtcagaatttgatcaggaaaacagaggacatcctatgtattataatgataaaagtttaatattaattagggccttatgctattattggaagagcttggtgaatagatattagaaaagcagctagacaaaatcagaagaggtctgttttatatcagagatcttagcctgacagtctagagtgtgggcacagaacccaagcttataggaatttctgaaaggtctgtaaatcttatccagatggacagtgggagctcataaaggattctgcaagccatcacatctgtcaaacctgctatgtctaatccttaagcctgctttatgtgaagacctcctcttcactcctcatttccagctctcatgagtttctttcataggcaaacccaaacctggaacaatgtgcctgaagacttcgggtgacacagtacccagacttaaataggaggggagccatggtggaagtggccatccagcacagttttcttggtctttactcatagttttgattccttaaaaaaattaaccacattaaaatatgtgtttcataatctacatctaataatacaaatatttaaagtcttttcaagtttgaatacgctacccatgttgctgctacccccattttgtgtgtgtgatttttttgtgtgtgttagaagctcatgacctttgaaacctgctcttatgagcttgctttgatgatttatttgtccagagaggattttttttcctacctagcattttggactgctatcaacctgagaccactttgaattaaattctcagcttgcaaatttggaagccacacagattgtgtgagttcaggctgaaacctgtttgagagctggattctggctataaactccacagggaacattttctctctccactcagagctgagaccatagggaaatttatttgctagctctctttgaaggtttattgtatttattttttaaatttctagtacatgtgctcactgaaggtgtaatacttatgtgagaatctcaaaatcagttgtgttctttgtatgaccctggttttgtttcctcctgctctcttactttcagtgtgtctcaatatgtctgctgatgctatggtcatcttaaattttgactgagggtggatcttcttcccagctcactcacatggttcttagctagattcagtttctctccatttgtaggactgaggacctcagttcttcacttagggttggctacaggtaatcatcaatttcttgtaacaggacttacactgggccactgacagcatgccagttggcttcattcaaatgagagggcaagagaaagagagagagggagagggcgcaagatgaaattcacagtatcttataatctaatctcagaagtggcatctcatttcttttgttctattctattcaatagaaacaagtacctgggaccagcttatactataggaaagagattatataagggtataaataccaagaggtagagatcatcaagagccattctggtagcagccacaatatcttatccagaatatttcttattcaggccttcaaatgtgctgtcttttctggtctaatggaaatgaaccttccttccatacaatttcttctcctaaattgtactctggctctcttatcatatacaaacgtctatgttaggtatttgtgtctgtcttgattcttggtaggcttttaaactctgtgaatgttggactgtg

SEQ ID NO: 39 - DNA, 2490 bp, Artificial Sequence
  Description of Artificial Sequence: Synthetic polynucleotide
agagagagggagagagcagtatcccagtgtattattaactaagtcaggtaatctgatttgataaagtgtgaaattgagaactttcataagaatatcaattttttgttgcaataaggggaaattgaatatttctgtttcatattaatataaaagtctttgagagcataattgaaacaaggaggtttcatgagactactaagattttgaaattcttttattatcttgatcaaaaaatgtattaagtaaacctgtaatactcagttgtgcctaacctgataacacattattgtagtaataatattgtagttgatatttctgtatccctaatttgtggaaatacttgtaaaatcatctattaatgcatgagacgatggcatttccctgttatctatgctcatggtagaaaaataaaagcttatgactctgctagagttattatttaacaaaataattagggcttgcatttttgtttaaatttcacttattagaattacctttctaaaacctagaatcagtatgcttctgcccaatcctcttcttatatttgctgaagacttgctaacctctgtataaacatcttagaaaggcattccaagctcttctacaatctggtacccatatatattttagtttatttattcccactgaaattctagctacccagcatcttcctctttcccaaactatgcatgttaacatgccagaattttgctgtattttaaacaatcattttgaaatgcctttgagacactacatctatcatctaccttgctcatatttccccccaaaaaagaaacagtccaaggaaaaatagttgaatgcttcaatgctactcctcaactgttactctaaacttgtatttattgttatgtatttggcttccttttccacacagatgatcttgttctgattccttagaaataaagtcataagctttcttcatctctcttatttatgccagaagttcagactcaaaaaccataagatgttcaaactcaaaaaatgtattcaaaatctgattggaatgcaaaaaattccgttaaaaattattcaaaaaaatgccaaataaaatccttgaaatatttaaaattgaagtcaactgtattttttataaattcattatttcttcaacaacctaccaaagatcttaggcaaccttgagaaaagaaatgtccagggaagcggttattttcctcctgttttgttgctatgtagtgtattttattttatgtggtagggcaaaagtcacttacgtttgtgttttcttttattataattctttttaatctccagagggccttagacatctctcagacttttcattcagtgcatgtttttaataacaatcagaaactgtgacccttatctgcctgcttttttttcttgtttctttgtttaaaaaatcttctttgttcttcaagtaaattaaaacatcatctctttcaaaatcttacccaatccaataaaacctttagcctacctattactcccttctgagtacatctgtatccattaaaattagtttttactgcatatatcaaaacaaaacaaaaggtaatcttgaaatatatttcatactcataaaaaaacaacactgagaggcagatttttcctggacttaatggctcaatggtcgtcaagatgacatactcctccattttaacattttgaatgacggtttaacatggctccttttgctgattttttattgttttgcatattttaattgaattaagagggcttaaagaaatgtacaaaaaaggaaagaagatgtttactgagaaacaacatgagcagaggttgtggtctgagaggaaaacttaaagcttgtttaaatagtaaagagaggactccagtgcttgtaaagttccagaagatgggataagagatagagagagaatcagagaataaactagattaggaaaagagaatgaacagattggcatgccacataaaagggtttggactgggacttacataattatcctgttatgattaaatacattttatttaaaatattttttaccaaaaatatgatgaaaaaattaaagcactaaaagatgtgcagatttacagattaagaatttagttgtgataagaggtgatagaggcttacattagggcagaggcagtggaattaaataagcttaaatgagaacttgcatttaaaggcttactgcagaagtcatctttacttcccaacaagctattgatgttactgccacaggagagtgttatgctgcttctttaatgagaagaccacatatttatatttttatttatgaaaggataaattgtctttggctgttttagttgtattttcagtagtcttagcagttactgtgaaataaaagtttcaaaggctaaaaatgcatgaagatacaggctaaacaattataataatgagctccaacttgacctctatcaaataaaaaacatgtaaccacatgaatcaaaaaggttgaattgaaattgagcaaataaaattgt

SEQ ID NO: 40 - DNA, 2473 bp, Artificial Sequence
  Description of Artificial Sequence: Synthetic polynucleotide
ggctcaagcccactttgatgaaagtacaagttcatcctgtattagttttgtcttccatgttagccataggcaaatgttttatcaaatactttgctatcacataccacagctcactatttatccagccttcattaggagtttaagagttttcctgtaatccagtagcccatctcaatgccagtagcccatctcaatgccagtgtgactcactctaggtgttaatgcagcactccccattctagctatgaattaatacattaatcagctattggtacaaaacgtagcactttcaaattcagtattataccacagtaagtatttatttgcaatgagaattgtcatttattctcagtaactattttcacaggggctcaattttgctggggtgattttgcttcatctatctttttttggtggagggtggggggcagtctaaagacacaaaagctctgtctttatggcagagatcaaaatctgccagaaagttgagaatgcccaaagatacctcttcaggcttacatttggagtttccttttgcttctattgactaaagcatctcatatagcaaaggccaaaatcaatgaggtatgaaaatatactctacttacagtggggcaggaaatatactatttgctgaaccatatgtaaatattcacactgcctaacttattttcatcttctcagattctcatccattttcttctttcagctattatagtgagataggtgtcttctatctttatcctgattctaacctcattctgtccttccatggataccatgtttgtcatgccacctttgttatagttttaataccttccctaccagaaacttcagatttaacccttattctcaactcacttctattttagttaaaaagttctctcttgacgctctatcacctctattctctataactggttttgactcttaaaacctaaacctaccccactacccatactctcaactattcacctccatcccccactaaatacaagcacacaaatgaggatacctgtacatatgcacaatactctatgttcctttaatttaggggtcatatatttcttataaggccagagccatgcatattacatatcatataagagtcaaaaattttaaatgaataaatcagaattgaatatgacaaagtattttgagttgaataaatgaaatgtaaagtgaagcaaacttaggtcaaatttttctttgagctttcctagttctttgtgtatgtttttcctatccactctcacagttaaattgcttgtatttcttgttaatgtctttgccatttagtaatctcactcatgtttgacttacttactttaatcagccgtgggctaaagtgcttgattaccaagcctattaagcacacttgagtgatacaactcggactaagagctcttatgagtaaaggttatacatgtggaatgggcagaaatacttgaattctgtgtcacctgattgtctgtagtttctgtgaaggtgaggtcaggactgaccttctcatcattataaacagcacatatcaaatagtaaaccccgagtgagtgggtgaatgcatgactgttcctggctgatatcctgcttccagacaatatggattaccaaacgagcgtcctctgcctctatgtgggattattatgtgtacttttcattcaggcatgaactacattcctgataatgaaacattagtactctttcaaattacatccactgtaaaattacaaaaaaaaggaaattattcatgaagttaaacaaaattgaaaatgggttataattctttttctaagaagtttttgaacagatgtttcttaactagttttaattgaatggaaatagaattctctgcagtatgtgctgtattggcaatgccaactctcattaaaataataaattcggaataaattttattagtattttgaagtaaaaatgagaaacctataagaaaaaatattataatatttgcttttaataacattataatatttatcttgtatcttgcacacagggaggtttaaaggaatacttttgtccacttatcagaaaaattaatcataacctcctctgcaataaacactttttgggtccattattggtttacaataaaatataagaaaacaatgaatgtcaggatactcccctgctgaggcaaatggtatttttccccgttcaatttccatgcacaaaattgctgatgttcttcagtaggtgttcacttattagaaaaagtcagaatcagaaactggaagttgattgaaaaatcttaagaaaaatgaaagcaagatatctttctaaatcacatcatttgataaaagtcattgcacataaaaaagcattaaggagtctctattataatacaaatcacatttctaaaagtctttcccaaaatttgtttcaaagctttcacgtccctacacacatactgattatataatgtggggactatttcaggatttaaacatagaca

SEQ ID NO: 41 - DNA, 2443 bp, Artificial Sequence
  Description of Artificial Sequence: Synthetic polynucleotide
gtgattaactggatgtgggactaaaatatgaatgattcagggcttactttaagatttagacttggtaaatagttgcttcttagagtatattttatcttcactaactaaagcttaaggtcctggagggtggagacttttccttcccattggctgcatgctgtacagaactctcctaggtcaggttccagtgagtagttgcgaactagccatctcgggtttaacagcaaggatatatttgaaatgctgcatgtattgctttctttcctcagaaattgtacagttcaatagggctatcctggagcaaaacttaaaaatgaataggcacatgaaaggtggagagaatccagaatgtcacaaatgaatagcataagctttctttgtctatgattggaattgaaggaatgccgaatgattttggttaccttatcaatatgcattattatttattttgatatcctctgaaatcactaaacatgcaaattttggtttccacttatttaccttgtttgtgcaaacactttttcatgtaacagcaaaaagattagtaaatgattcttcaatataagcaatatttactagaaaaattaccagcatacatgagaaatgtgaattacttattttaatataatgtgactatttagagtgagctctaaattactagaggacagctttaagcagatgtttgagaatgtggtgttcagagcaacatatgatgtaccacagagaagttggtacaagagaagctgccttaactgaccacattgaaaaaacctgcaagataaattttgctctctagtctttaagtaaattatactcactaaagcctgtgacagcacaaatgcttgtggtcaacatacacatttctaatatgctcacacccttctgtttctgtaacttgagatgtttacttaatgagtcaattatatttcttaccacacgatattgattttattattaatttcttgtcttaaaaatttgatttttacactacagattaatatggttactaatattttaaagataataatcatttgtaaagaatcttgaaaattatttcgagattcatggaaacaaaagaatgtagtctctgtaggagagatggttgacacactaaattttgatttgttctcttttcacaggaaaagagctgaagcaatgcatatggcttcacagctggagaccacactcctcagcctccttacaaccaacctgtcttgtttgaatccattctcttcaagggaatgagaacaaaatttacgtgtgcagcttccaggtcagttacaatttataataaaagtgaaatctcttgttctggactgatgctttctttagactggaaagcagattttgcaatgatataattttggtcatgaagataagggcaatgtcttattagttgatagagaacaagatggagaaaaccaccctccctagaagttctcatgaggcagggttaccctgttaattatactgtttcctgatggagaaatgaacttctatcatatttaagccattgattgtattttgggattttcttcattacagcaacttagtctctatccaaaaagacgatttcttatccatcaattccattcatagaaatataacctaaataaataatcttatattgaaaaagatagtgctcatgcatacttttttctttctttgtcccaaaggaaaaataaagaaacattcataaattaaaaacaaataaagtttgtaattttcaagaggggactactccacacacaaatgagactatcacagctttgaattcttaaggaaatttgagagattttatcatgtcccagatattggacataagttatctctttatatatgcaattatcctaagaaattttccaattttatcaataagggatgttgacaaatgagcataccctgaggaaaggtatcaggaatcattccatgtggaaaaaaaaatgaaacaacaggaaatatttagagaagaaattatgtatgacttgataggtttatctaattgtttcagaacgacccagtataatataaattagactgcaaattaatcagggacagagttagggtcagtcattggaagctaaaacaaaccaaaacataacacaaatttcagctctactaaaggaatatttttctaatgtgtggagcctcacatgaatgaagagccaattatcaatgatgtccaaaggaagatgaaatagtgttcagctagagaatggcatcttaggttccttttaatcctgaaaattcataaatctttattgatattctaggcagtttttctttatcaatacaagttactaaaactttgcctaatttgaaaatcttgaatatcagtttttgtttaggtaattgttttgacttcctctatatagcaagaacacaaattctggatgacactgcttacttccaaatcctagacctaacattaggaaaagttgct

SEQ ID NO: 42 - DNA, 2412 bp, Artificial Sequence
  Description of Artificial Sequence: Synthetic polynucleotide
aattaatctcaataatttgccgatactttattcctatattctcctatattttgttcctatataattcctatattcaaaatataggagaatgtagagaattatagaaaaataatcatgtgtttatttgaatggataaacagaagtttcgaaacattcaacatctgtttatgacaaaaagctactagtaaattagaaataaaaaggaatttcctcaatttgacaaaaagcaacaacaaaaagttatagctaacataacacttaatggtgatattgtacacttttcttatgttgggaacaaggcaagaatgtctgtgctctgcatatctattcagcactgtactggatgtcccagtctcattagttaagaattaattaggcaaaggcaagaagttaaagtcataaactggaaaataataagtctactacatttatttgtaggtgacataatcattgtctatacaacaaagaacatttaattccattctatgctttttactcagtccctagcctgcataagtagtatacaatttgcaaagttggtaagagaaccaaattagcaatatggtaatccaattcaggacaaaggacaatcatggaaatttgattagaaatgcattaatgtgttaacaagctacctttgctgtatctaaaactttaaataaatatgaatagcagcaaaaccaacacaaactatgatttataatggattataatggataaaatgtcatatagaaacattgaaatcaatttggaaatctagaaaaattgaatttttaagaaataatgggtacaaaagaaaactcacaaatgcaaaccctttgtataggtgaaattcatatttgattcaccaattagttttttttcaccatgaatatttttttatatgaaaaagacttgatgctaatgaatatacttttaatacaacaaagataaaatgagaaaaacattatttaactttggttttataataattaacttggcttaatggaattcatttggtatactttaatttggagatttaagtaaacactgactccaggaggctagagaaattaggatttttagattacagatgcaatatggagatctcatttaacaatgacggtaactttgagataaaatacgggggaagtagcccagaggcagctaaaattctccatatacagtgaggtcttatctacaaagctccccacatcaatatagtttacttacaagtaccaaattgagtttgtctgctcttctgaaagtggtgagttaagataagggtcccaacagatgaacagctgttactgcaggtgagtgttctacatcaggcacgggattttcaactcataatggagtgacgttgaaccacatacaatattatgaggattttcccttgaaaccgttaaagagctgtaacatgatgcttgtgaatgtcaccactaggtggcactgaaagttaaacagttattgaacaggctgtggaatattgaagttttcctatggaaaaaaatttgattttttatgttgtgtctatatattcttcatttgaccttaaaacatagcagtagcagacatctcttgtaccgtgccttacacctcagcccatttgttttcctccagcccttggtgaggctcttggttacagaacctcagctcagctcactgcatatccgctgcttttttgcactaagtctttattcacaatgtggttgggacacctgtgagaagctacttagcatttatgaatgctcaaaactgcaagtgtgggggaattaagacccaatgggcaatccgtgactattaggggatgggagtcagggctttgtgttcctttcatacccctcaggtggacaattctgaggcaagatcttcattgctcatcagaggattccggcgaggtcagatccagttttccatagtggcgaccagcttgatagtaccactctattgactttctctcctttcttgttttattctttccaatatattagccttagtatctgataacatgccccaaagtaaagtcatttataaagctccccacgttaatatagtttactttggctttctctcctttcctgttttagagtcggcttcctgtaagaaacccaagcataacctactaccctgataaagaacattttcagcacccagaactctccttcatggctccttttcccattcaacgctctttaaaagagaactaataatctattagttctatttttgaacttcacattactggaatcttggccagtactattttttgtttgccttcgtaatttcttttttcttttctttttttttgagacagggtctcgctctgtgcagtggtgtgatcttggctcactttagcctcaacctcccgagtagctgggattacaggtgggtgccaccatacctggctaatttttgtattttttttat

SEQ ID NO: 43 - DNA, 2388 bp, Artificial Sequence
  Description of Artificial Sequence: Synthetic polynucleotide
gctgcacacagagcgcccctggacaccaaggcttccctggtggggaacactccctgtgtgttgtcacacatcaatgccaggagagtggcgctgtccgtgactccacgggagaggaccgtaggggctccatgtcaggcactgtcctggactctgtgctgtgtgcttcttcctttggctgattttaatctgtattccctccctataagagatcacaaccatgagtataacaaccttcagtgagttctgtcagatctcccagcgaattatcacaactcagggtggtttggggaaccccttgacttgtagttggtgtcagaagtcaggatagtgttttgtggactgtgtcccctcccacttccagttggctaaaggttcacaggccatcactgactatacaagggaggatggctcattgcaggggggctgatattttagccaatgactaaggaacacagagctgcaaagtgaggtagattgacccccttagtctcttaaagcaacacttctcaaaagctaatgttcatacaaataatgtcggaatctgataaaatgcagattctgattctacaggtccaagtgcggcctgatctacatttctgataagctgatacaacagctccttggagcacatgttgagtaagaagatcttacatcaatggtttccaaactgtgttacatgttaaaatcccctagggagtttttaattatcctcatgcccaggctacacaccatctaatggtatgaggccggtgtccctttccctgttgttgcagtgttggcaggtagagtcaatcaaagcatggagccaggtaaagctgtgctcatgattgaaaaatgcaagctaacaatagaggttgagagattgtgttttagaaggttgtgaaataagaaaaacaagactgacaaagaagcaagtagctccacgtgggattctccttgtccttggggatctcttccttagcatgtggtggctgtcatcgccactctgacacagccctagttactcagatcccttgcagcagctcagctctggaggggagcccgggctcaatggcaggagcaggcaaatgttggcccaaactcagcattgcagtgacattcttatcaggccattaagtgctgatattttactattactatatatatattttcatcactttgaatgctggattcggtagctaggaaaggacagccttagaggtcaaagggccacttgcctgaaaataaggtcctgaaagaaaaaaaaccagaagcccaaggggatgatcatgtgttatgaaaggaaactctatggagggcttttcaaaatgcctcggcatctgaacatatcctcatgggaaagaccgccccaacacgaatgtggcctccacagggtttcaagaggagtcatggaaaaggcagctggggccatttcctggggaatgggtgacttcccaccccataagtgatgtccctgcctccccatcccactgtgggcctcagaggttcaaactacctgttgcatctgcatggtgtggacatagaggcagccacactgaggagcaagcaagaaagggcatgcggataaccttgactcccagggccccagaaggcactcaccaccttcactctggccactgcaatgtggcagaactatactcccaaagccatattgtttattagaataataagaaaactatcatacattaagtgcagtaaatgtgccaggcacgggaccaagtgctttgtacccaatgtctcatctaacatggacaaaacccaataagacaggtattatattattgccctttttacagaggaagtgaagcttggagagccccaggaacttggccatagtcatgtgacaagttaaagcccggttctcaaagccaggctgccaggctccaaagccagggaaacccaattgtttctgaatgcccaggggactcaagcaactggtccaaggtcacatattgacctggagaaggagcaaggcagtgaaccccagagagaggacaagcctcctatgtgttgtggtgcctcaggacccatcaggaaatgatctggccagagagatgaccccttccaagccaagggatagattctcagaaccttgacacagctctaagaggggagtacagtgcgtaatatgataagtgccaggaacggagttgcccgcaaaggaaaatgaacactgtggcaagccctaagtttcccaacaggaaccagaggctgtaagctaagtaaagtcattcaacaagtgcccagggtgtgacggcgtaagcttaggagagactggtagccttctcagaggctacagatgccccagcagaacgcccaccaatgtttcccacatctaggatcttctcccctttgaagcatccaagacagccatcagcaggctggaga

SEQ ID NO: 44 - DNA, 2374 bp, Artificial Sequence
  Description of Artificial Sequence: Synthetic polynucleotide
ggggagacccagaacttccagagagtgtcctggaccatgaaggtgaccaggaaagggaataggtgggtggaggccgctgcagtgaagcctcaggccccctctggtctctccagggtcatcctggatcatctgaatttccctttgaaatgagcatgcacaggttcagctgattcataatttaataccctgtggggttcatgccacagggaagctccgctgccccacagggtctgggccaggtggaagagagcagcctttttggaccactggcggtgtcctctccttcgccatctaattgaagcccatcttcccaatcaaaagcaggcgaagggccccagcttcttctaacactcactccctggccctcactggcctccctgcctctctctgcccaacttctggcattgtgcaaggtctgagacctctttggacatgaggcatgtggtcttaacctggcccttgttccagacaggtgggcggacaggtaagcagagccggtgctcccagggcaggcgagggagccatgtggtcaggcctcaggaccctgggccccaccgggagatgtgctcctgggctggaaggaagcagaagagagcagggctcgatggcagcccaggcagtcccaagatggcagccctgttgcactcggtctggaagtgcccatggccgtggtccctgtggcgctccaggccttcctagcagaggctgctgggagctggtgccatgctaggtttcacctccgcctccaccacagttcatggggctcccgggaacaccaaggaacccaacaggttcccaggcagcagctttcatgacaggagagggtccttggagaaatcccctgcagagctgtagctctagtccttcctgcgtggccttgctgtatgaagctgggcccgtcgttgcccctctgggctcaggagcccacaggtacaaggccatcaacagggcatcctctatggccccgtgtgcccagacccactctgaacctgccacctagatacccttgcaggctggaccgggtcagcagcacccccagggtcagagatcagagaaggggagcctcaggaagtccctcaccaaactggcagatgtaacggtttcgggttttgcagcgctggtcgttccagttgaaggcagctgaagcctgcagctccacgcagttgccaaacctgcaggccagggtgtggtggtcaggaggcaagagtgaagtcagggatccgggagaggcctaagccctccacccatcaggaccctgcatctcaggggctccagtgcccccacctgccgacggggctgctgggagccaggcccgtccccaagcccccagccctgctccacttctcagggaagccccttcctggggtaacagctctgcctaccccatggcagcactcagccacaccagcctgtggggatggtggggattggaatagacagcccacttgagaggtacacctgggaacccaacaaggcccagacttcctccaggcaagaggccaggggcacaggccggctgttggcaaggagggctggctgaaatcgctggagcccttggtggcctcgcagccggaccacctccaccctggccctgggcattgctgggctttgaagagcagggtggggccacgtgaccagagggttcttgctacaggatggctggtgggtctgcaggtgcagggttgtattgtgaatgagtgcaggtgggtgacagctaaggaatgctggcatcagtgtaactgatgcaggcagagggcatgcagagggaggggtgagtggatgagaattggagagatggagtcacagccaggggacactggggatggacagatggatggaggcttcctgggtccctctctcccccacggtgacgtgccttccggcttgcatctccctcaccccaccaccggcccacaccagctgtgcccacaactctctggcacctgggcaggcaccagggaaggatcagaccctcaaagggcccagccaggcagtgggatgggggggctccaccaggcaggcccaagtgagaaggaggcccaggggagggaggcaccccacacttacccgtggttgtcaggctgcccaaaggcaaaactggtgaaggcctggtgctcccctgtggcccagcggaaggagtccttggcggtcttgtaggtgagccctgggccggggtagtcaaggttggcccactcagaccctggagtctgctgccagctgcctttctggcccctcttcccagcgctggcagcccccatgtgctccctacctgggcccttcccgggaaagggggtgagcagctggccccgctctgggctccaggccctcaacacacccttgccatctgctggcagccgccatggcccagggttcc

SEQ ID NO: 45 - DNA, 2357 bp, Artificial Sequence
  Description of Artificial Sequence: Synthetic polynucleotide
atgcacacacacaattgttgggtttgtttttctggagaaccatgacacatcatgatcaaattgttaaaaaacaaaaataaagagaatgccataaaagcagccagagataaaggacatgttatgtacagaggaacaaaaataaagaatatttttggcagaaatcacaaaaaagaagacaatggagcaacatcttttaaatgcttaaacctagagttttatacctattgaaaatacatttaaaaaataaaggcaaaataaaactttttcagccatacaaaagctgaatacatgaatctctgggagatacatattataaagagacattaaaggaagtaattcaggtagaaggaaactgagaccatatggaaatatggaccaacacaaagcaatggtaaacctcagaatggttgctatgtgggtgaaaagagtaaagctggagttggattataaaaactttgatggcaaattatattctccggagactctttctcaacatgggaaatgttttctctctcaattttacaacttccttagatgtacactgtggccctctcagggacatctattctgattttcttgatttagacagatttctgagttcacacatcattgtactctttctgagttctcattgatatagccatttctgttgttaaaattggtattgaggttttctctggaaagataaacttctcacatactggttgtggaactcagattttcttctttctgactgctggcattttcaaatatgtccttctcacttatatggcttatgaccataacgtggctatctgtgcctgagtgaccaaccttcatgagtgatcaggtcttctagcaatgggcagtagagtcttggattggaggaaaactttcttctttggctcataccatttatatttttcatttattcagctataaagcaaaggagattagccacttatggcccaagctcttttaaagctcctctgtggggatcccctatatacaaaatgatgtttttttcacaataattacattcttgttcaccctgcttcctcttactctgaccttatcctccaagcttattgtgttcactatcctacacatgaactcctcaaatgggggagcaaagtcttggccacatactgctttcatctgagtgtgctgattccctgctgtggccaggccacttcgtctacatgacttccagctccttctgaactgtaaacaaataccagaccatgtctgcttgacagcataattatatccacgttgaaacccctgatagacattctgaagaatgcagaagtggcaggagcttggagcaagttcttgtaaaagaaagcgctaaaaagtcaacaccttattatcgtagctgtgaaaataaataaacaacagagcagagtacttcaatatccaaataataaatttggacacacccctagaaaactgataattggggtaaatatttaaataaccatgaatatattaatccttaaatatgtcctgaacaattccatctttttctttctataagaaatataatatcaagcatgttttaaatgctacacatttaaaaatatctaaaattgcattccatgaaggattaaatttgagaaatattaatacatttcaactttaacgttttagtcactgagtttggttggtgacaaaaagaacatgtataatactcagggactgaattatttcatgttaatgaaacaatttattataaactataaactgtatctgatcttgttgatataaggattagtgatattcatattgtggattaaagatagatgtaaatattgtgatgcttgtcccattaaaaaaatgggttccatttctccccatgttgaataggctggccagaaactgctttgactcatagagtgtggcatttgtgatgctgtatcaattctaggcttagaggacagtcaacttccatcttggtctctagaagactggagctaccacataagtctgacttacatcccctactaaggagatcacatggaaagggtacatggagataaaaaggaggacctatctaagtctagacaggcctgagaatagagtcatgttggacccttcagactagcacagctaccagctgattaccaccatgtgaccccagttaatgccacatggaacagaaaaaattacccagctaagctcttattagattcctgaaccacaaaattgaactatacaatatattttttgctgttttaaagcagaaaagtaaaactccaaccaaccaaatcaacaaacaaaataaaacaaaaagaagagaggatgagataaaacaaaagaaatgataatagagaccatcttcagctcaagattattttatatctgccctataccat

SEQ ID NO: 46 - DNA, 2347 bp, Artificial Sequence
  Description of Artificial Sequence: Synthetic polynucleotide
gacactatttaatccatttagatctcataaatctacgaagcatttggttggtgcacaagtaactgcagtttttgccattactttctacgacaaaacccgcaaatacttttgcaccaacctaatacaaaccaagggataagggatgcggttgctcaaggtcatacaactagtggttgggccagaatgaagctcaggaagtctggctctacactgtactctttacctccacagtctacatcccagtacttctcaaattttcatgaacatatacatttcttggagatttttgttaaaatacagtgggttctgatgcagggtctgaggctctgcatttttaacaatttcccaggcaacaacaacactgctggtttaaagactacactcctcagtaccaggcctcaggggactcctggagatacagaacaagaaggaggtctacgtaaagattttgaagtcatcactctattggtggtcattaaagctgtatgcctacactgaaaagagggctaactatgagacgggacggatacaaataactcagagaatgcccaagagtaattcagcaagatgagacacgatctattggattgaacaattaaaggtcatcttttccactggttatggtgaagtcagagccttggttatagtgaactgaagaagagaaagttaagagagatataggttatatacttttaggggcttttaaagagagtaagcaacatggggtaggagtttggaaaagggaaaagcatagtggtaaagaagaagtctgttgttgtttctttgtttataacacgatagaaaggataagcagatttataggcacaggaaacaatcctaataataaccaaaacaaataaaccgtacatagattagaaggatgtgttacggggaaaaaaataagaagaaaagaggaagcagaagaaggtaagtgaaatcagggcactggagagaaggtaggggctgcaatcttgatgatagggctgcagtgaggtgacacgggagcagactaaagggagataagagcacatcccacatgcccaagaaactgcgagaaggccaagatgcctggaatgaagtgagtagaggaggtagttaaagatgaagccagagagctcagccaatctattaaatataacaacaaattatttagaaaatgagaaaaataagttaccaaacctatcacttaaactgtgattaactcaaatccttatatctttgtttttgcctccgatggtgattgctcttcttattactatgagcactctcctcactacttttcaaagaaaccatgtaaactgtacattactatgctttgaaaattaataatattcaatctatataaataggacttactcgcagtcgtacaagaggcttctctggctggtgagaattacccagacgttcccgttcagcattttcaagcatttcttcaatctcaaaatttttaaaaagattaaaaaacaacgtagtaaactgagtttaacttggctgaatagcagcttattaccacaggaattttcctgaactacataatcatctttatttcctaggtcatttatgacaccttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatgggagactcaccagaagatttagggatcaataagcaaggactttagattatttatcttggaagagttcaaggtaaaagaaaataagactgatgttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaattctagttcttagaaagttcttgtattggaacaaaaactgccttcctataacttggtcctgatctcaagaacaatacagaacaagtgtttttgtcctcagatttctttcacatctaagactttataatcttgtcctttaaactgtctgtaacaatgaagtccaaaagagttttctgcaataattttttctatgtgcatattcaatatggttgccaaaaccatatgtggatatagagtacttgaaatgtggctagtacaagtgagaaactgaa

SEQ ID NO: 47 - DNA, 2282 bp, Artificial Sequence
  Description of Artificial Sequence: Synthetic polynucleotide
acagcaaacagccttggaagatgcagcaaaaggcaggtttgtttactctttagtgtaataaagataatgtcttccttcaaggcaaaagtcaggcaagcttgcttactgcccattataaaagatttaggttccctaagctcagagttgctcttctctgatgtcaaccactgcatttgcaggcagcactcacccctctctgcattgctccatgagaactaaggcctcaacaactggcaaaaaatactgatattctgacactgttactgggtaagaactacacttcctttctgacccaggagcatcctgtttcttttacagcatcagtgaaaacatggcaggctagcatgttagtctgcaaggagaataagatctcaaatcccttatcatccttgccagtgttggtttcaataataggatgttgacagaaatagaactttttgcaagaggagggatagcagctcaacagtttttgcatgtcacatgaaaatggtatattaaagaaacagctggcctggccccagctgttaatgtaaaggtagcagctctcattggcaggaagcctgttcccttatcctcttatagatgattataataaaggcctggtctctgttgagattggctggaatgttttagctactggatcaggatatgcagattttttatggtgaattaagaatagcaacctcagcacccaaggtgagaatacttcaaaccgtagggaaatgggggagagaaggacagtaatggcctttgtcttccataattgtccttggagccttccttgcagagttaaatgccttgatggagctctcccaactgtcacctgtgcctgaaataatttgaatgccttctcccttaccctttcctgggaaatattctagaaataacaaaggtgccctaacacctgtacccccaacaaaacatttgtaaacacctttgaatgtttcctacccccattccccagccattgctcagttgatctgaggtcataaaaacaccacccttctggcagtatagcaaacagaatgggttagaccgacttccatcatgctttgctccataaatgagcagtaagctaaattatctgaactgaactgggtagcctgaggcctacaggctaagggggagatcattttggaatcactttcatcctatgccctctagctaatgaaagtcttacttgggattccaataagttgaaataattcttttcagggcactatatgcactcctggattttatttgtgtggatcccaggtattaacttgccttcttcatggaaacctggtgacttagaatcggtcataagagacctctgagtgtctcaggaaacacttccatagattagtattcctcaggtgactgcaggttggacacttctggagggataactgattcattatgtgaccctgtaggcagtcagtagtcattcagtcagaaaacatggtagacgacgtgtccctcattgtggttaaagtggctgataatattacttcagccctggaagatgttccactcagcttcattcatggagtagagttgctatgaatgataaatcttccatagccttcttccttgcagaccaaggcagagtctgcacaattattgatatgttctgctatacttacattaatgcctcaggttaaatagaaaggtcaatacagaaatttaggaagaaagccacatgggatttttagatagaccttgacaatatatagaatttgttttgctggttagatttgaggcatctggaggtatgtttgagcttaatactttctctaggttgacctgattatgctacttagagttctgttgatagtagtcttaaataaataaactatagaacatattgaatggattttgtcccagactctgctggtcagattaatcagggtagctggcagagtgtcatattcatggaaaaattggccagaattcaagaccatagaagtgagtatggatactgttggagtcaattctccatggattttcccatttctacgcatcttgtgagcaaggaactgcctgcactttgttcaaaagtatgttttcaagaatgtctgcatatttaacacttggaagatagagataataaggccaggcctgcttactgcctgttttaaaagatgtaggttctctgaactcagagtttctggcctataatgcaactcattgattattcatatatcatatggccttctttgcatctctctgtgggaatcgttgcttgggtaactgtctaaaaaatgttaatcttttggtattgctactgttgtaaataa

SEQ ID NO: 48 - DNA, 2275 bp, Artificial Sequence
  Description of Artificial Sequence: Synthetic polynucleotide
gaagagaggaaaggatgttgaaaatgtttgtaacagaatgcttctgatgaaagaccataaaatctgagccagataggagagaataaaagataacagtacctaattaacagagataaaataggagaatgacttgacggtatcaactagaaaggaaaattgtttcaaaggcacacttgagtaaagtgagctagaaacaagggaagttaaggtaggaaagtaaggtctctagatttgttgtttaggatatagtctaatatccgggcgtgacaaaatccaggaagtgactctgggatcatatggctgaaggggggtagtggtcaaggtaataggtgtggaggtcaaagaacaaaggggtgagaacattgaatgaattatccatatgcagccctgctaccagccaatatggagactttatgcaaattagaaaatggcacccccttcctcaaaatgttttatcatcatctgccagaatctgtcaaaatctctatgcaaatcattgatggcgacacagatggagcagcctcctggacttacatagctgtaagcagcagccctatttatgtgtgtcttgaatccagcaagaatcataggtggtcatggtgaaaaggaagatgttccaggaaccccgtttggcagtgacagaaggggaataatcagaggctgttggccgtcagcaacaagaagtgggagagggtagaaagttcaatggcaagaacctcaggggaacagagcttttacaggatagagaaggagtagcggtgtagaaacaagaagagggtgcaaggagaggacaacaccctcatctcctcaaactcaggtatttgagatttgtgaaacaagcaggctctgcacagaaaggctgtggcagatggtagggtccctcaatttcctaagatttagctcaaatgttttctcctctgtgaaatatttcctgattttcccagctggaaataatttttttcttccctgaaatctctagcaactaatttgtgcctcttttatctccagatcttgttctattttaactatgtcatttcagtaggttcttacctactctagcagaaggtgtggtctttgggagtgggtctctgtctgatgcatctttgttctactataatactgtttcttcatttatttagtcatggtagaggcataataaatgttgaatgaatgaatgaatattactatttcattttgctcccaaatcttagtagaattaattatgtttttgaactagctttatctatattgcacctagaatcaatgtaaacggaatttgcagttttgcaatctgggtacaaggtaccatatgaattgtgtttaatggtaatgtctgtctttttctttctttactacaacagacttttcccttttgtagtttttgagtagcagcaagaatttcaagtattaatgataactatatttgatataattatcttttatagcttgtatttttattaaacaacaaaaatcccattttgttatttaaaatgatgattataaacaacaatcaattgtgaactgacagtttgtcttcagttcatacaatatttttgttttgtgaatttagagatctcatgtgtgactgtttcttcagtgaattcagctatatattttatattcataataatatgcttcttcccagtataacaattgaaaaaatgagattcctcactcttttgaagaccatagaatacataaataagtatttttggattcctgcgatagaggttattaattgctttatgtctaatattggtaaatgaattccttatttgattatggtagagtgtatttttatcctggaagagcaaatgaaagacaatttaaaaatttctcctttggtttcttaagacatatactctcatttctaaaagcttttaaaactcctctcgtcttatcaacaaatgatgctagaataaccggacatccacaagcaataaataaataaatctagactaagactttataccctttacaaaaattaactcaaaaggaatcgtagaccctaatgtaaaagataaaactataatatgaacctcctagaatataacatgggagaaaacctagataataacctgagtttgaagatgacattttagatacaacaccaaaggcatgatgtgtgaaagaaatcattgataagctggacttcgttaaaattaaaaacttctgctctgtgaaaaacactgtcaagagaatgagaagacaagctacagactgagagaaaaaaaaattgcaaaagagaaagctgataaaagactgtaatccaaaa

SEQ ID NO: 49 - DNA, 2271 bp, Artificial Sequence
  Description of Artificial Sequence: Synthetic polynucleotide
gtctaagcacagttatttactttcccctttaagttttttctgtttcattttgaatttatctcactgtattaaaatttttatgcctgcctcctccaccatgagctcctcgagggcagagactttgtcttattaatttttgagtgtttatattttcttcttattctgtacatagcacagaatctggcagggattcagcgagacttgcctcgtcaatatgtgtgtgttaacacagatacttttgcaatataagggatgagttcagagagtagacaatttccaaatcacgaaggactgcctcaaaaggaggtggaactttatcctgtggtcagcggggaccctaacagcagagtagaccacggttacattgtgtttttaaaaaataacttgagcaacaatttgaataggagggagactaggtaggagataattacgatagcaaggaaagatgatgagagactgaattgaggcagtgacagtggtaatgaagaagatagaacagagctacagattcttcagaaggtacggtgtcaaatcctgaattattatttggacgttgaaaataaacaagaagaatgaattggtgaataaatcctacttctaacttgggagctgctggtactcttcagccagatgtgaaattcaagaaagggagcaattttagggattaagttggttgctatggagtctgcaggtgtgaatcactgtgaatcctgaaaatcactatggagctgtgtcaaacaccacccagttgcaatggaatataggcttcgtagaataccaaggtggcaatgtcaaggcatgtgattccagcttaattgttttcccttacagacacaccttgccttaaatataaagcttctatttctgtgtctggatgttcagttatttccaaatattgtcctggcccttccttcagcatgctggagatctgaagccctgcatatagccaccaagaggtacacttacttctacttcctggcagaaggtagcattgggtccatattgtagctggcactggtggtgaacatcatagatcactccgggggcaatgaccttggacttcaagcctttctttttaggtatgtcatcaagacagaacccccagcctcggctgaaaacaagttaacagaaatgagaggagttgtttaggattccctttaccttcagcctttcattcaacagaaacttccctctggtttactctttgtcctttaagacaactttattttttacaaggcagagaactctctaggcccatcatgggagttattaaagaaaatgcaaatcatatcccacaacataagcttagtttatctagaaaatacaagccatggtaaaattagaaaatcattatcctactctcaatgaggtttgaatgaccactcttatctctgttgggtgttcctgccagttcccaaggacttaattcataattggctcatagaaagctattttggggcaggagcaatctgggatgggacaggatgctcacctgcctgtgacaagagggcagagcccatctagacctcaggatcagaatgcagaagtgaaatccgccccttctgatgccaccctgacatggtggcctgtgggatggaatccagccttttccaggcatcagcttctctgtgtaaaactcaatgcagcttccaatttaaagagacccaggtgagggcgtcatgagacactgtcacttactccaagaagcgggtgatgtactcctcgctgcacttggaccatgtcagcggagtgggatcgtactggagctggcgggacatgatgtacggatgtctgcccacaggctcacagtcattttctttcccatcatgctggatgccgaagctggcagggaagaaccaagcacaagaagagccagcaggcaggcattaaacaggaagaaaaaccatagtttccctaagagcgtaataactcacagacagccacgtttgtacagaaggcaactgtttgcaaagtgagactttgaagtcggaggggcatagctaattttcaaatgaaaaaggacagggagcattgtaggcatgctttacctcaaatatgcatccatgggagtcatgcagctaattcagaaacttctgcttggcagaaggctaagagctctgtctggctttctttctatgaatcaggagtcaggaaggcaaatcctgcccccagctatttgctttctcctgctgcagcaaccacagtgcacagcacaaaagaacaaaaccttccttctcccttttcatcagaatttaagagacagcatgaaag

SEQ ID NO: 50 - DNA, 2235 bp, Artificial Sequence
  Description of Artificial Sequence: Synthetic polynucleotide
gcgctctgtgtgcagctggcccaggcaccgggctcagatctaacacatacgctctgtgagagcagtgggtgatggagcttgccccatctcatctctcaaatgagaatgctaaggctcagagccatcacattacccagccaggggccctggctaggcattcagattccaaatctgggctctcacctgcacaaaggcatacgctaggttagaggggtagatcaggctcaggaggggtcactgcctgctgtgtgcgtgcatctgtgtggtcctaacactgcttcagtgctagagcagacgtgctaatagaggcctaagtgggccgtgtctatgtgttcctagggcttcccagctgtgctcaagaggccaaggtcactgccccatgcccactgagcctctggctccctgacttttttctcatcccagaataggagaatggggccaagcccctcctgaaggcagatggggatcaaggttgggggcactcaccagggacccctaagcattgagtcagaagcagcaggagtgggagccaccccatccttctggctggaggctgcactgtgacccaccacagccccatccgggaagttgcaaaacctgtccctacgggattgggtggctctggctccgcacgtcagctcagggcctgctggaccctgacctgagacctggtgacaggagccatgaggggccaggcctcaggtcccacaggtcagttgcaagggcctagcacagctagccccctgagaggcctccctacttagtggtcaggtgttaggaaggtttggtggggacacttgaggtgccctggggttggggtgaaacccctctgcagcctagtcagcccaagggcatagtgaaagtgacagctgccagaggtctgggttccagcccctggctgacattaaacttttctgaatttcggtttttccctgtaaattggggaaaattacttgccccagcttcaacactgcctcccctccactcttttgctgctgccttatcaggccccagctgtaggcaggtcagcccacgcccggcggcagagcccagagaggctcgctcatctcagccgccagaagtgtcatcccagggaaggtgagcgaagctgtccactaggactaaataggggtggaggtaacaggtagcagggactctggcaggaaccgcctttcagacgttttcaggaccgtctgagcggggcctccaagtatgggtaggagacaggcggcctagggattccggttagcacgtcgcgttctgccgcagcagggctgggagcatccccagggcaggcggaggtcggaggtggtgaggcctttcggcgaagctgaggcctggaacaacccggtgggaagccacggagggggtcccctcgcggaggctgggcgcgggccggtgcgcgtgcgcggctggaggctcagcgcgcgagcgtgcgcgtgatttggccctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcaggtcctctggagcttggggccaggcgggggcgacttgggggagccatccttgggctcccagacggagtaggttcagttctgagcccggataccccggcgaggttggacgggatagccgtgacggggagtccccgggcggggacaaggtccgcctctcacctgggtcctcagcaactgacaccaggagtgggtgtctggaaggtctgctcatcaaatgaatgactgcatttaatcagatcttcaactactctggtagtgaaggggcaccgatcatggaggcccaccgagggcccgaggtccggaaaatcaccttcccgaggagcaggcgtggtgcagacccacaggggtttgtggcgggagtagagggtctgtttggggcgagataagagactgaacggcagagtagggagtgctggctaaggcagtgctgcagagcgaaactctagacctgcgctgtctaatagaactttatatgatggtgggaatgttctacctttgtgctgtccaatagagtaaccgttagccacatgtggtcattgaactcttgaaatgtggctgaggcaactgagaaatcgaattgtt

SEQ ID NO: 51 - DNA, 2220 bp, Artificial Sequence
  Description of Artificial Sequence: Synthetic polynucleotide
ggaaactaaccaacacagcctttcagccctcatcaaaggtgatgcaacttattcttcctacaattaataatcattacagggctttaggaagtaagcatttttaaaagattactctagttgttgagtgaagaacggacccacatcagctgcacctctttctccaactcctcaccacagccacagagcacagccactgccacacacaccccacagaagtggttgtcatggtcctgcagagaggaagatctaagatttccctgaaccatcctattatcccccatgctctttttatatcccaaaatgagaggcatgggactctaagtcctgccaacactcaactcaggaaggtcgttcatgtgctcttccataaaaaccaggagggccagcaaagcctggtgctttccagctctttcctgagaagttacactcaatttgtccctttaatgaggtttttccacagcagcacagaaccagtctcctgctgagttattggtcagggaacacaaagccaattccaccctggtctcctatttctggcaagaccatcctggggctatttctcaaagcagctggtccttctagatgctagccctctgtgtgcacacttatatctcataatggatggtgacctatcagatgcctttgggtcctccagagcagctgaccagtgccaagtacataggaggagctcaattcatacattctgaatgaatgaagaaatgtagactatctgaatccataggtgaaaataaaatccacggggtaaaaaggtttctagctctgtttctggctggaaagtgcatgaaagctgagtttaatcaataaataagagttgtagctactaaattcctctccacctggccccagcaaaggatacatttacatctcattccccaaatgtaggacatccaaagaccagaggtcccatgagacgccacttcttcaaatgccgacattttgaagaaaacacaccaagatatttccaaagccctgaccacatacgtggtcagggaaaatgcttaaagcttcagctcctttcagaaaagcaaaaatcaaaccagacttatagcactatcggccagtaatggttaagctcacatgatgtgcaaggcattcactgggctaggagggagaaataaagaaatagccctgtctgcaaggagcagatgatctcaatatcattataaggcccaaataaatgaattatggtcttagacaagtcaacggctccccacaagatgaaagcacaaggtcacactcaatgaaatagagatgaactgaattcttgtgaggacataggacttcgaaaaggaatggcatcatgagctgggctggctggagacagatttaagctttgaaaactgtggtcaagcagaaaagagataagaggacatacggagagaagtaaaaaggggaagtagaagaagcggcccctgagattccagggaacttggttccaaatggtaggacaagtgggccagcggcaataaaattagagcaaagtgtccttccagcagctggggacaggaagctcgaggatagacactgacctatgccaggaaaggcctggaagttatgtccagggaagaagaaaaataaataaataacaccttgcaaacacgaggggacagtttgtattttaaagtcttggaaaagtaaatcaaagtaaacaggaaccttggagccatcaggttactgttggaaagctgatgggagatgccgtaagagaaatgggttcctattctccagtgcatttcaactggccatattctcagcagtgaatgatggaggcagagctcagagaagcacgtctgaacacgtaaggaccgagaggcgagtcttcagtgaaacacccacagagagccgtttgccccttgagattcctgaggagtgtggagagcaaagaagcaaacccaatgagtcacagtgtaaattattcctattagtcagtgctatcttataagcacacatacacataaagcacttctgctgcagactgaagtatgatggttgtctcaagagaaagagcttatacaatcgaggtggacaatgaactacgtacttttttcatgaaacactattttcacttaaaagaacaactaataaactatggttattcagacttagatatttcttgacatgttcttgagaaattaatgaagtgagcttgtcacttaaaggaaaacaactgacagtatttgctgacactggtaaaactca

SEQ ID NO: 52 - DNA, 2201 bp, Artificial Sequence
  Description of Artificial Sequence: Synthetic polynucleotide
cttatccttactaaagcccactgtagcttaggatgaagttgccttctgcaatggtaatttcactatcctgtcagagtttcctggttctaaggcctttgcatttgagacatggtatcacactataaatcaggacacattttcatgtgccagggagtgtgcccaacttgtaaagaataaagaaccacatcctttacatgtcaccatgtgtgtttttacagacatgccaggcctcaggcacattcctctgtcttgtatgagatttataacagcaaacttcatgtaaacacacaggagtaaggtcatgcaaatatattcatcttttcattcaacaaatatttcattcaataagtatttactgcttgtcatgcaccagaaacttttccagggaagcagtgaacgggagagcaaaacggtgaacaatttgcgtctcctgagtacttccattttagggtgtttgtgtatgtgtgtgtgtgcacacgcatggatgtgtgcaggggatggtaggggatggtgggtggtggtggagcgaattatctaggcagagtggataacaagaatctgcactcagtgctaagtggggaaataaagccaacaaggggcagagagagggcgagcagggctgatgggcttttcaggggagtcttaatgagggcccttccagccaagactgggacatgagggcatgtctggtggaagagcacccgggcagagtggtagagtgaggagcggggcagagtccccagcacccctggtgcagttgaggaacagcagggaggctggtgagactagagtatgggcatggggttagagagcagggcccaagtgggtgtggggcctcttccagagccacggaaggatctttgcttttgctgagcgagcggggagcacttggggcaatggggcaatgggaagagctaggcagaggcaggagaatagctaggacaggtgggtgaggtctgcagggcagggcagggcagggcagtggagggggggatgtaattggattcaggatatagtttgaacacagaaccaacaggattttctccttggatcaaagatactgagtgtgataaagaggcatcaaagatgactgggagattcctggcctgttctctagaagaatgggactgctgtttctgagagtggaaaccctttgggagggtttgcttctggccaaatgagcacaccagacccctgagtggaggtggaggtgggcagtgaggatagtgattgagtcccgagttaggcatgatggtgtttgcagcctggggttggatgagatcttggagggaatggggagagttggggaaaaaatgaggtttaaggtttagccctttctattgggctccaaggagtttcaagaccttagactcattgctgagcctcttgagaatctctgcttctgtttgtaagagaggataacagcagccaccccacctcgcagggatactattatgattactgaggtgatgaatgcatggaagctgcttacatgagttcccagttctgtctctcctctcctagcaagagagaggcaacagggtccacagagctactccaaagccatctgattgcaaacagcctctaaaagaagtctgggaaaattaccagggagatgtttcccaccagctctgctgcttccctttcaaaccttgcgtttggccactctctagaggttggtccctttcgcccatctttcagagactttcctttgctggtttcctacacaccccctccccctttccaaaacctagctgggtttctgctccagttttgcaaacaccattctcacctaggtgccaagataaactggccggaggttactgttgatggtgctagtgggtatttggttaactttctcaatcaactggaggtcacagggcccaccccgaaaagtagctgccctaagaacctgctcttctccatcagtgggtgggtggtggggagggggtgggagatgagaaaccaggaagcagagatttctgagaggatctagaaaaagagagatcatctacactctgtcaggcggttttcatgcataactgataaaaccatgctgttcttgaaattaagataatggcactaaataagagcacatgtagactaaatatactaaatatacgattgtctcatcctgatcaacctgatagacctaacaataggttcagcacagtgagaaggatgatagtgtgcttggtctt

SEQ ID NO: 53 - DNA, 2182 bp, Artificial Sequence
  Description of Artificial Sequence: Synthetic polynucleotide
ggctaacatgagaggattgcttgaagccaggagtttgaaaccagcctgggcaacatagcaagactctgtctctaaaaagaaacaaacaaaaatatcttttcaataggcagagctgtccaagacctgggtgcattctgtggttaagactgaattccccatcactgaaggcactcaagcagagactggatatccactgccctgaaccaacaatgctgtaagcatctttctgtctgttcttccatcatcatattttccccaaccctcttcttctgcctgtcccccttccacatttaaggatgcttgtgatgactttgagccaccagataatcaaagacaatctccctagtttaaggtcaactgattaacaaccttaattccacctgtaccctaattacctctttgtcatgtgagagaacacattcccaggttccagggattagagtgtggacattactctgccagccacagcaagtgctccatgtgcagtgctcacattgttgtgattcacagcatgtgaaccaaaggcatctagtccttgtgtagctgtcaagtcccctccactatctgctcagggcagggcatgcagtaacaggtgaccggggcacagtgcctacgggcccagcttcatctgtcacccctagggtgtttattatggctaaggtagggctgaggagcatttgcctcctgtcactctaggacccccgtataaggcatgtggaaggacagagcacacacgtgccctggagagcagcatcaggaacttgcatctactgaagacgctgcatatgggagcagagcctaggagaatctgtgcagatgcatgagggactcgctttcaggacagatgttctgagtgcatgaaactgcagccataacttcttgcccttagacaaaagggcatgattagaaaaatacaacatgttcaagaggtttcaagtagaacaactttgaaagatcagggtaaggttctggcacatgcgcctgacccagggactgcacctgttgcctttccataagctccctcatcaatcctcaaggaaacctcatcaggaagacttcttttggtccctgcctttcagaggatcaaaatgaccctcaaaatggctacaattactgagcaaataagtgatcaaagctggagtcatattcaggtcccacggtttggaagtctttgtttttcacaacacacttcattgcctagggcagagaacgccatgtcttttgtgcagtatcttcaagcccatccagcaggtggagacgaggaggggtcctgggatattcaagtttctcactccacagctaagaccgtctcccatactgcactgatcttagggaattacctctcaatagcactaccactttaactcctgttcagtgcagaaaatttgaaaaatatagaaaaacaggaaaaaattaaaattacctagaattagacattatcatcatttgaggtatcatatagatatgtattgctttttgataaagtaaaatttttctgctcataagttttttatggcttatttttcactttatagaccatagacactttcctgtatcattatctcttcttccatcgtatccattttatagctgtatgtggatatagcgcaatttattaaaacaccctctattgttggacaattagatttttgtgggtttttttttcatattatgattttgcaataaaatcctggtagataaaactgcacatataattgagagtttccacaagacacatttctagaaatagaatgggccggccaaagcatatgaacattgttaaggtccttgttgcagactaacaaaaggcctaccgatgctccccttggctgtgtatgaaagtgtcccttcccccacaaccacagtaatgctgaattttatcttttttaaaaaaatctttgcttctgtaggcttcttggttttaaggggtcccgtctggcattgcatggattaaacagaagtatatgtgcaatggtcctcttctcctaggatttaactcaaaaatcagcaaattttctgtaaggaccagacagtatatattttaggctttgcaggccattagatctctttcccaattactcaactttgccaatgtagcatgaaagaagctatagataatccatacacaaatgaacatttgtgtgttctaaaaccagtttatttactgcgctctgtgtgcagc

SEQ ID NO: 54 - DNA, 2174 bp, Artificial Sequence
  Description of Artificial Sequence: Synthetic polynucleotide
aggctgaggcagaagaaccgcatgaatcccggaagtggaggttgcagtgagccgagatcgcgccactgcactctagcctgggtgacaaagcgagactccatctcaaaaaacaaaaaagttatcctgggcaacaggcatgaaactctcaattttttccaagaaaactgtgacatatattcatgcttatatggaattaagagagtcaagacattttttcccattgagatgacttcttgtggaaaatcaaagatatttattgagccctttcacattcagttttgaaacaatcttgaaataattcctattcatgtcatttgcataattccacacatggaccacctgctttatgagtttgccatgtatgtagaggacatttccaccagctcggtattcctcatggggctcccagttcctcacctgcatcctaggacaattctgcccaggaatttattcttctgggtcctttgtctctgcagccatacttctgaaaccacagctgctgggcctctctgagccttcttcatgtgatggcagaggcaggcctagtcgtagctgcagaaacaaaggtgaaggaccccctgaagctggctggtgggtaaggagcagtggctcgggctttgttgctggtatggatttctcctgtttgctgtggaatacaatttagggaagtaatgagggagccctgtcgtgttcaccacacacaggctccatcagtgcaaaatttcactcggcagatgaacacagacagatgcacattttcttcaccaatgaaatattaaacatgacaggtgtgttactcatcgggaaacgctgcatgcaaaatgcatgtgtaacccacgaggtcttcctcatttcatccctcctgcttggctagggttctaggagatgatattcctcctgcaacgatgttcaggtatccaattccaaaagttacggtcaatggtatctttgggaagatcatttaaaggcttttggctttaaattaaggatccattaagataataaaatgttgtcttcgactttattgttattctgcctaagggatctgtgggagaacacaggattaaaaactatggagagaaagattcccatcactatggaaacagattcatttatttttataggctgatttctaattcctctccctgggcaaagctcccactaacttctgatgctaggagatgatgcttattcaacagatattttgttgcttggggttgcttttcctgtttatttggagagaagggtggtaggagaggagggctcagtaaagaggcaagctgtataagaatatcttttcaatggtttgacttaaatcagagtagccaactgattggagtgagaaggccatatttagaactcactaccaatataggaaaaggaaaccccttaagtgttactagcttgacatcaactcttaaaaaatgcaaaatacagagagagcaggttcaagaagcataactcctgaataaaattctgtctgttgactatgttcagcctagaacctcataactatatatagagaacatcacaaagggtagcattctttaggaaccacaataggtttccagtcaactatttttaactactcatttcttactgtttttgaagtttatattacccaatgggatgccaaattctctctcttacaagcagggatcttgtggataaggaacagctcttacttcccctattagcaacttccaagaacaaatgaggattgtaattgatacctgctgctatgctgttgcactctcagcctgagaagtgctagggatataaatagcagcttgatgatttaactcagtctggtttaagagatcatgtgttgctgttactttgcatgaaaatgacatcatgcctggtattcaatgtgctgtgcaatccaacaaactgaggatggccaatcacagatctctgtatcagaatttggtcaaagctctggaatgcaggatgaaacagtgcatgcagaactggtagaaagatcagtggagcaattcatccatcaagtctgaccaaacagctgccactcccctttcaggcaactcagacattagccatcagtcctggaaagccataggagcaaagccagttaaatcatgattcagcaaattgaaattcaagtaaagtgcaatgcagcagcgtgtttgcgcacgtgtgtgggtgtacgtata

SEQ ID NO: 55 - DNA, 2143 bp, Artificial Sequence
  Description of Artificial Sequence: Synthetic polynucleotide
ggtttaggagagtaaatatacaaaaatgaaaacaaagggaaatgctatgtggttgtcgtgaataaccacatttcctggaggatttggacatgttttattgtctgatatcctttttttcctcttgtgttttttctggccactgtgtattttgcccgggttctgtaatctcagtgaggggtcctgccacactcaagctgcataaagatgcccacaaaacatgtaagctctaggcccacaaggaacccagcctagaggatatcaaacctctctgtgttctgtggtgtctgatttgcctgcttagtaaagtagcagaacttcaagaaatgcagtcatgtcagaagatgagaaagaagatgataagtggcctaaatcctgcatttttgggaaaagaagctgctggcttatccttttcaatcttccatatgagagaaaaaaagtcaaaaggaaggctgataataagcttaggaaatgttgaccacaaactccatagaaattcatcagggaaagatgaaacagatgttttacaagtgaagtgtgaaactggacctcagccctccctccttaactacctgctcccaaagcaggttcaccaggagtggtggatgtgggtgatctcctctggctggtctgactgtttgacctccatccactgctcttcccttagagagagttgccctctagggccttctcctcagctcctcccaagaactctgcccaccgccctcccacctcattcctcggcctgacgcatcaccttcttctcaccacattgagttccatctgcagcagcgtccagcttagagcgacaaaagcccttcacggagcaccacagtgtctggcagacgttctagaaaacaaattgcacttcttttgtattttcaaaacctgccacaaagcatttctatagttacagtaaaatatgcacactcatccacacactcacaataaatgccactgttgttagtgactaagagtgacagaaagcaatcattagagttttcagttcaagcttaacttggactttgtcatcattcataaacaatggtctatagatcatactaggtaatatggaaatgagggataaaacctattttctaagggttgagatggtcatttctatatgtttggcacaatatccagccctcattgctcttgggaaaggtaactggtgatcatctatgaaaggtaaatctaaactgtggctggaaggcaacctgattactaacagttgggggtggttataacttgagcctgctcagtgaagaaaatggaaactcttccatctagaaagcctcagcttgttcacttattaccttaagtagtcagctggtttcagtttccaggaagagagctgcatattccttcttatttctacccttatggggataaaggaaggttggcaggattctcagatgccatctgaaatggcttagctgcttccatctatctatcagtatttttttctgtctattcatcttccatagttctatccacttattgtgttctacactgcatgtgttttttcattatatgacttgatattttaagccattttagaaaattatcaatctttctctctctaaattttgcctctcctttctctccttttggaacccgtaattgttgttgatggaccttcttattctgtactttgtgtttcaacctcactttcatattcctcatctctcaatcttgttgtatatgaaaaccgaagaaactttctcctccatcacacacccctaagaagcacccaagtgggaagggaagtaattttctcagctctaaattccatttgattgattttcttttcaaccatgtcaagtctgctgtttaatccatccactgaatttttaagtcaataaccacaccttccatttccagaagttatatttattcttcctcatatctgccttacatatatcttctggttcttttttctcatgtacagttcattcttatatatttattttattatccctatataaaaattcaatttttgaaagttcttaagggcttgttaagggcttcttaagggcttcagctcacttagctgaagatagactacattagatttttgaattagaggctgaattatgaactcatctgaagggtggcttttttttttttgacagagtctcactct

SEQ ID NO: 56 - DNA, 2136 bp, Artificial Sequence
  Description of Artificial Sequence: Synthetic polynucleotide
agcagcaatttcagaatttgtacaagggaccacgccttcagttttgtctcttcagaacacaccatctgtggcccaggctctctgggggacctagcacatcagaaaattccagagaagactccacttagtgtacaaacattctaaagataatttctctcatcactaaattctcgcagggtctctgtggtctaaacataaaggctggacagatttgaataccatccatccatcctttcattattcattcaacaaataccaaaggcccacttgcaccaggaagaccaggaagtgatagacagacattaggcacaccaagggttactcatgacttcggaagggctcaacatttaaaaagaatatagactgaaacacacacagtcataaaatggtgtcatgtgcactttcacagagagaggaaaaaggtgatgggatttcgacggggtgaagacatttcggctagaaagaggcaacacaggttgggattcattataagagctgcagaatcaggcatgagactgagctcctgcgtggttcctttttagctgtatgatgagggcaagtgactaaccatccaatgcctcagcttccttatctgtaaaatgaagataagagcaggaaccacctcctaaggtgctatggcgtgacagaaactcacagcactcggctgtacgtgttccatgctcgtgaactgtcattgtaagtttcatccttgctgcctggccccatgactcccaaggcagagagctggacctgctgtctcaaggtgtctccagagtggggtctcttttgattttctccattttccacttttgggtctggtttattttatgtggattacactgggaacgtaagaaaggaaatggaaggtgcatggctaggtacacgctgatcccctcataaatgtcctctgacggggagggctgaagccccacagagcaggagggtcagcaaagggtggaaagcacctgagttttcatttcccatttgtggactcttacaaatcagcaggaactgctgggaggctgggctcttaatggcacagcggcctcctgagctggggcgggcaggactgcaggaccgtgaacaggcaggcaggtcctcctgaagggatgggtggtacctgaaggggtcccaaagggagatgtaagatcttggtgccagcccagtctgcctgctggactgggccacttcttttgctggatctgttccctgtctcaacatgagaactcctgcctgggacccacaggaccattatgaaactaggagagtatgaaaaaatgcttgcggtgccggcacagatagagtaagcccaggcaagctccaacaagcaatggccgaggcccctggcaagaaggcggcaacagctggctcggggaaggaagataaacctggagaaagacaggcatcatgagcttactggggtttttgccttttttatctcccaggactgagcacaaaagctctagaagaaaccccctctctctagacagaagactgagaagccaggctcctgtgagctggcagtttgaggggaatccccgatttttacttgttttctcttttttctctcctggtcctgcctctcaaagcagtgtcagttgctgagctgtgttgccacggttgcgatggcagcagtgacagttccgctggccagaggaagccagggaagggccccatggtctgaagagtgtgggggctcccttgatctcttccattttctctcactgctttgcctgcagggtgccctggcagtgcagacctctgcagcagcacatgaggatgcagcgggcagaaacgcaggctttgcagccagagggttacacagaaaggcccatgggagctagacagtgtcaggggaacccagagggaggaagctggagaagggaaccccctaagtttgtggtgtgaacctgtacatattttgggctcaccccaaactgcatgcacaaaagagattcaaaggagcacagtaaaggctctgataactgaactatggtgcaaacccctgccatgtcgagactaacccctgaggggtgcacctgcaagacacacccaaacgacatgcaaccactgcttatagaaggtgacagagaattttcagaccagacccaaactgccacgcgctctgtgtgcagc

SEQ ID NO: 57 - DNA, 2132 bp, Artificial Sequence
  Description of Artificial Sequence: Synthetic polynucleotide
gcgctctgtgtgcagccgggtaaaatcacagtagggagacctggcaaatactgtctcatcaaggcgatggaagttatcatcagcaattagtcatattgatagtgtgcattcttgacctgctgtacttagaatgacactgcatttctgtgttttttctcccaaaactcatgactccaggatagccatgagaaagatattgatcaaacccaaattgagtgacattctgcaaaaactttgatcagtgctccttaaaactgttaggtcatcaataacaaggaaacttgttgtttctgagaaactgtcacagatcagaggaggctagggagatactgactcaatgtaacctggaccataaaaaaatatcattgaggaaaaaaattgatgacacctgaataaactgttaggttgatattatgatgacatctgaataaactgttaagttaatagtaacgtaccaatgttgatttcttacttgtgacaaaggggtcctggtggcatagaacaataacagtaggggaaactgtgtagggctatatataaatactttgtacaaacgttgccacttttctgtaaatttaaaacacttctaaaataaaaaagtgttcttaaaataaaataaatacagttacatgagtcacagggaaatgtactaaatgcaaataaaagaatgtaatttgaaagtgtcagaaagtagtggttgaatatatttgaatttctcttgttctccttgtgctcctaggggagcaattctttgaggtttaattgcctttaaacacttatgaattgtatatttaaagactattgcatatcagattttatgccacagaaacattttattgagtaaaattgcttattctattaaaattaaatcattttatggatgatatttttcaaaatctttttggagataaaaggaaaattcaaaaagcaatgatgatgtgttattccaaaaaaagtacctgtgatttttgtttcaaaatatcaggtgctaattttcatcatattttaaatttcatttgaatattactcttctattgtaaacttgtgctgaattcctgttgcatttttttctaggagagggaaaaggaagagttagctttgggataggagatcaacactgtcttacatacttaaagactctgcttaatgacatcctgagagtcatcaagaaggcttgatagagataaccaagatttatatatttgatttagttacattcaatgtaaaattatcttgctcttctgaggcattgagtctagacacttctcataatagaaaaatccttattactctattagacatgaattactttagacagttttttccaaagttccattatcagtgttgttgctaactgactgcattagtctaaggatgctaattgctataatgtaatctccaagcttttatggctaaatataataatgatttatatctcattcaggtcacagccagtgcaggtcattgggggcagaaggtttgctccatgtatcatcaagagtgaggcttctcccacctagtggttctgcccactattacactggcaaaaatagacacatgggagagaccaggagtgtttgtccaggcctccattgcagagtccaggggtatgctggtaagtgtttaataatcagcagtcagggaggaaaaatttttaaagccttgatttgtagcaattgcaaatttccatggtgcgtatatatctcccatggtctatcagaagctattcacaaaatatcagggaacatgaaactgggaaaagaggtgcatgttcagcacaagccactttgagttggctccaacccaccaccaaatagtccctcccttctgcaaatagacactgaggagaaatttggattaaagcttctcacattacacatgtattgttgttgtatgggatggttgccataatcagttctgaagacagtactttgcataagtttagactaaggtgctgtttatatcatatctgtgtgactcatgtcccaatctgcatagcagtctgtggcagatctactatggaataatgctgcttgatcaaatacaaaaagagcaaaaagaggaaaaaagaaagagaaaaaatgttttctttcctcatgaagtaataacatctaaggctgcacacagagcgc

SEQ ID NO: 58 - DNA, 2117 bp, Artificial Sequence
  Description of Artificial Sequence: Synthetic polynucleotide
ggggatatgctagcagctggggtgcatgccatgtttgcttcttagtcctggttgtgagattccatcctccactcaagcccaggcttcataagctggtgctcaagtttttctaatgcctggaatagcaccactggttccctggaccatacagagtttgttaacagctaggatcaagaaaaatgtcttactgtagctgcttaggtttcagggcatgagccagccactcactaagttagattcagggttgaaagagtcaagttgcattctggtggctggattttacaattccccaggggaaaagtggactgcagaaagacactcactcaccctctctcatagtggggattcactctcagttcctggtctatcatggtcatataagctgcctgtttttttttttccccttctttctcaattttggagattcctttggcttttctgttgaattcctatgttccctcttggataatatattcaaagtgtgattgcctaccaaccattttcattcttctaaaaggatgaggcatgctagaaatgcttctaggcagccatcttgggaaaatttttaaaaaattgctgttttactttgtttcttttgttgtgtagtgcttccctgattggtgctaatctttgtggctgtgtgctggtgtctgtggatttgaagaagtccctattctatctttgcagactggctttgcatgggaaagcccttaattagtcagactgtctggaaattctggggctgccatctggcctggtccatggatgggcttgctgctggagttcaggcaggttgacctggtgcctagggcagcagcttggtgggcctggtgcgtattccacaggattgggtctggagcctggatccactgtggtggtactggtttgcaggggagggcctgaagcctgtattcatgagggctgtctttaaacctgtcaggcatgggctgacctggcacttgagtaggccttaaacctgagtctgcaaggatcagccgggcattgagattgacctggagcctgagtccatggggcctggcctggcatggtactgtggtatgctggagactgagtccatgaatgtgagcctagttccttggtctgtggggaaaaagactaacctaaaacctgggtcttcctgggtatacctggatcctaagtgcttgggacaagactggctccagggtctattgaagttggcctggacttttggtttgctgaagcaggcccactggcacctggggccatggggatcaacctgaagcctctggctggcctggtgctgaggcaggtgtaaagcctgggtctgcagtactggtatggagcttgaagttactgctgctggttggcctgatgcccagagccatgggggctggcctggggccctggggccattgggataagcctagaagcttgttgtgtgggtgctggtctgaaggctaggtacacaagggctaccctgggtcctagggctatgggaacagacctggaacatgagtctacatgggcagtcctgcatcctgtgtccataggggctgaaccagcactggagtctactgagatgggcctagctccagagtctgctggaggttggagctataggggccagcctcaagagtggtgctgcagggtctcacatgacactgggcaggcctggagtctgtgtgcatgagtgtcagcctcatgcttgaggtcagtgatgccaacctggtgctggggtagacatgaagtctggggctatgtgagttaatataactctggactggtctggaacctgggttggtcttggagtctggggctacagggcttgtcctggtgctaggtgggcctggagtctgtatcggcagaggctggcctgaaggctgagtctccaggttctgctagggctgagtgggtgggactagtgtggagtgggcctgaagtctggggccatggaagccagcctggtgctggggacaatctggagcctggggttttgtctggcagtatgtcaggccctaagaccaagtctgccaggcatgtgtgaagctcagggctgtgggatctggcctggcaccagggtaagcatagaggctcagtctacaattacagcctgaagtattgggccttgggtttgg

SEQ ID NO: 59 - DNA, 2111 bp, Artificial Sequence
  Description of Artificial Sequence: Synthetic polynucleotide
atatcatctatcacctatcgatctattatctatccatctatctatcaatcatctatctatatctttctaatatttttagatagatagctgtcttttccttataactgaaaaccgagctgttcgagttagctttagattttaaggcagcttaaatcttaaattgtatatgtttatacacggaagtctggaattacgtaaaaaatcagtgttttatgattctcttcactttctctctgtagccttaggactagaattgttctagtctgcttcatcttaagacctaagaagagtagctctctcctccctgatctacgtaaaatgactgtctggaacagacagaagtacagcccttctctctggagcaactttctgtgtttagtagagacttctcttctatggctgtctgcctggaatcagctgtgaaatgacgagtctggactagaggagacaaactattttgtgaagctgtcaccctgtctgaacttctgaaaggcctttgactttggagtttcgtttctttccatgaccctatccatgtgactgccttaggttgtcacagaatgagtgattcaacatagagacttccaggaatctggactctctgagtatcatttacatagaaatacgtttaaaccctttagccacaagcattaccgggcctatcagtggatgaatggccctacccactgttaatcaatgagccaacgatgccctctgtgaatcggcccctaggttgtttgtttcttcactggaggttgagaccaattatctcaaaagctttctggtgccaaactcaaattttaatacatcaaattgttttaaacataacacacaacaagcagatttttagccaggtacactttgcctcttttgcacaccctgtgaaacctatcttctgcttgccattgataaactagagcctatggccataagatcccaagctgctactgcccttaagagctctctgactcagagacgccctgctgcactgctgagcaacatcatctagtaagtcccctctcccattccctttcccctgggaattcacttgccctcctccttgactggtggcccctttgctgtgagcctcaggacagtcttatgccataggagactttcactatcattcaattctgcccaataaagcttgtcatgcattgctatcatatccttctccttgatcggtcaggaaatcccttgaaccctataccctgctaccagggtttgtgttatagggcaacatgatctatcctggggagctgggaaaagctttcataaagaatagacatttgagctgtgatcagcctttcttaaagaatagatatttgagctgtgacctaagggatgggtagggcttaatcaggttcaggggagaggaaatattccaggcagaagatgattttatccaaagaccatgagctgagaatggcttctttgctggaaggtgaagtgtaaatagggaaagtgtgaaaagtcaaggtcagtgagatgtctgtattatgcaggctcttgtcaacaagcaaagaactgtacgtgtgtgcatctcacactttgaaatgaggaggaggtagcagcatttacctgttgcctctggaaactatctgggggcccaaagtcctgggagctcatctggatttactttggagagattattcagattttaacccagagagacatatcaagttctttgatgaaagagcacggaaccaagcagagattgttgtgaattcatggcatatagggcctagctgtccctaagatgcattttgttgagttatatgatattattaaaaaagaaatttgaatagcttgctgtcattaaagaattgggacatttcttataaaatatgaatatctggcttcctttgaaaaattagaaatttagaaacgctgatatcacattctagcatgaaaccaatttgctggagaggaataatggcagtcaccttagctggtgcctgctgaattcatttctctatagtctccctgtctcccttagaaccttactcatgccatcttcttggcctggtaggcatttgagtttattacctcagaactggagggccatcatttccttctactcttgagggcagggaccatggtcttttaaa

SEQ ID NO: 60 - DNA, 2109 bp, Artificial Sequence
  Description of Artificial Sequence: Synthetic polynucleotide
caaaaccattcaaaggcttctcttttctttcttctgatacagtattgcttagatggtctcttcattaagctgagtaagagtgcagattttcaattctttggagagattcaaagctatctatccctattaccttttcattattcctttagggtctcatttagtactaactggtaaattttaaaggccaaaaattttcactgcagatatgttttctgattctgagatagaaattatatctggaaggataatataagagaaaaaagatgggatctgaaaaggttagaacagtttcaatttactaattcattcaatttcaagatcaagactttgtatttcatttttagttttcttccttggtagcgcatacaatttatataaaaaataaagtttctacatacacgattctcattaatgttttggatttgtttctaatatttttccatcaatttatgtgaatcaaatcttctcttaggatccctttcacagttcttttctttatatccagatcttctctctgattttttctttctttgtccctatcatcttctcttttcactgcggctgttaagttaaaaaaaaaatcagaaagctattgatgtcgctatctttctcctgtcactttcatcagaaaaaaacagagttccaatgtgccgcatccagttgcttagcaacaatattttcaacctccctgccagcatgaagagtgtgaagctgggcctgctaatgtggctgcaagaccaaaaagagcatagtttgagtggaaataggaaaattaaaccctgaaaaattcaacaatctcaggatataatgaatgcagaaaaggatgagcattttacagtgggagcttcctttttctgcatgacatatcactggcagaaaactttcttctctaaagcaaccttctaggagttatgcaatcaaaaatgccaataagactgtgttctgcatccagttcctaaactgatccattgctttatttttccatacatatatttacaattccatggaaaagtagatattatgaatgtgaatgttttcagcacaagattgagtaaaaaatttttaataatgctttttcaaaatttattactattattttaatgaacaaaaactgatggcttttctatgtaagtttgtgaatatattcctattctttttatgactactttaatctcacattatttttttttctcagtaatagaaacacgtatttagtccatgtttggtaactgtatagctttcttgtttttaaataaaatgttttgattgctttatatttatgttgttcattggtatgtgtttgaaaatggataaatgacagaaagattgtcaacagagttcataatcaaaataattaaatgcaaaattatactttcaacgagaagattaaaaactaataaatatgctttatattttttctatttgtcatttaaaaatacattttattgcatataaattaagaattacatacctttatcagttcacatgacatatataattttatcaaaaactaattataagttaatttaaaagttgtttcttgaatttaatacattttaatatagtgtggtattctattttgagcaggaattgcagaaactggtatcttgtgttccaaatttgctttgatgttttcatctgcttgataatctggaacatgttttataatctgcctaagattcagtttttgcatattaagtgaaaataatacttcctaacttcagttctagtacaaaaaaaatacactgagataaccaatataaaacactaagcatatctggcatacaaacaatattcagtaattttaaagtcattgttacttagaaatttttagaaattagtgactagaccagataggttttgttccagacattttatcacattttaatgtaaattcatttttaaacattgaagcatactgacagcagcagcactcaagacattaagcatttagagatatagagtccacagaagtagagtatatgtgaataattaaaaactctaacagtagccatgtatgtagactgggtatgcattaatatttattagtatttttgaataaaaatgtaaatagcagactgtggaaaacatggtcataaaattctttat

SEQ ID NO: 61 - DNA, 2106 bp, Artificial Sequence
  Description of Artificial Sequence: Synthetic polynucleotide
gttgacactcagtattaaccatcacaaggtggaaggtgagatcagcagaaaggggctaaccctgaactggtagaactcagagtttgagggcaggggctgatcattggtgcccagccacagtagcactgctggcaaaaaagaaacgaggtgcatcagagaaatctttccagatgaggacagccccatcctttcctggcctccaaccctggaggagccagagatagcacggttagtgggcaagggagaggagaaaagcaatatgaagaagtagatgaccatgctccttccttgatgtaagctcaaagcctgcctcaggcctgagctaagggaagaaaataatttcataatcagatgaaaacgtgaagttgatattagactgaactagacatttataactgaaaaaaagagatagaacatttatatccaagatggatgagaaaggcaatgctacctagccaaatctcatttggaatcttggaaaaaatgactcagtggagcaagtttaacagaaactggtgagaaagaaaagttgctttctgctcgtgaccaccaccaagttcagggggggaaatgtgttacttacaagtgtcttgctttaaaaaacaaataaataaaattaaaattaaaaactacatgattgattttaagataatcaaatcctcgcaaggcatgtgtttgcatatcaggtccctgccaatcttgtgaactccatctcaagctaacccccacctacacccacacaataactccagccacgtagatttctggaagcttctcaaaatataagctgcttatcacctcaggcacatacttttccctttgcctttgaattgcttgcctcttctcatcctcacatggctaatttctccttattcttggagtgcttataggcaacagaaactagcagaaacaagcagaaagtgaattcattggaagggtagagggtagctcacacaaacaaatactaaagaaacaattcatttaaaacacagctggaaaagaacaaaagccaagggagtccaaggaattaagatggaaggaaatgatggacaagctcttccagagggtgaatcatcttcagctgttttcattttgcttgttcacaggagaagagtcagtgctaggctgggacataggctcacccctgactaggagagggctgagtacttgcacacaatgcagaagcaaaaattcctcccaagaaaatcgggacacaattactacaataatggtaggcaggcaaaacaactgaaatccactccacttaagaacgactttaaatgtttcttcctttgccagttaatagccagcaacctttgggtagattgcttacagtatctctgcctcagtttttaatctcaaaatggtaaaagtacccacctcataggatagctgtgaagattaaattaataaatacatataacccactgagcacaactattgtacacaggaagtattatctgttattatcttttcggaaaattttctatgatcaccttgccaggtcaatctgttatattttcttatcccatcttacatttctcctttgaacactcagcataagtgaacttcagaattatttgtgtaaaggtgtctatcccactaggctgtgtatgtatatatgtatttgtataatttttaactgtgtatatctcattggctctataagggcagaggaaatagtcatcttttccaacttgtatatgtttccaatgcataggtcatagcagagtaccgtagactgacaatggaccccaaagatattcaggtcctaattcctggaacctgggaacattaccttaaatgagaaaaaggactttgaaggtatgactaagttaaagatcttgcgatggggaggttatcctggattgtctgagtggtccctaaatgtaatcacaaatgtctttatgaaaaggaagtagaaggagatttgatacagaagaagagaaggcaatgagatgtcaaaagcaagaagttggaatgatgtgaagaaggagtcacaggccaaggaatgcaggcagcttccagtagctagaaaaaggcaaggaagccaattctcccctagagcctccaagaaggaaccagccctgctggcaccgtggtgtt

SEQ ID NO: 62 - DNA, 2086 bp, Artificial Sequence
  Description of Artificial Sequence: Synthetic polynucleotide
gtaacaaattaccacaaacttggaggcttagaacaataaaaaatcattccttcccatttctggaggccagaagtctgaaatcagggtgtcctcagggctgtgcatactctgaagcctctagaggaaggtcctttcttgcttcttctggcttctcagggagtcgtgttagcacgtaggctggtcatttggaacaaaatgcaagctgactgcccagccgagccagcggggtcaaagagctcagtctaaaaattaaactattgaaagcactacaagaaaacaagggagcattattttatattggttttataggaatagaggaggcctttccaagtgtaacgtggtggccccaggcattccttggctggtggctgcatcactccagtctctgcctccatcttcacgtgaccttctctgtgtgtctcttataagggcaattgtcattggatttaggggccaccaggataatccaggatgatctcatcttgagacccctaacctaattacatccttataggaaaaagaccgttttccctataaggccccattcatcggtactggggcctaggatgtggacatatctttttagtggtcaccagtcaactcactacagatgggttggtgcttaagcagtgagcagagtggtcctctgtccgcccaggggtgttccttggggtggggccaattctgggtcctgctgctcatccctgggccatctgtccctgcagcctattgggaagttctgcaaatccagtggcctccactagatcaggagtgatggggaaggaacacagggctgcttcagggagcagcgggctcagccctgccagttagtggggaaccgcgctccggccaaatcagagctggaacattcaagccagcctttgttttcccaagtaaatccagcttgcttccatactgtttctcagtctctggcgtcaagcgagggaagcattcctggaaaaatatgtcctctgaatcatattaccatcctgatttacattataatttcttcagctatgtattcccagagggaggaaattggctacgagacatcaccaaaaattcacacataagcacaaagcaagcctgaaagaaaaatcctatttgcagaaaaaggagccagtgttgcaaatgtggcttcccccatgacagaaatggccctggttaccagcaagaggcagcagggaagaagcccccctttctggagggattttccaggttcttgcttttttaaaaacagcatttaaagagagcagcttgaataaatccttcctcagggtttcctggagtgatcatcttgttcctcccttctcccctcctccttctctgtcttctctaccctctcttccttctttaagcccactggcttctttagtttttatttgcgcattgcagataacacttctctgctgaggacctctaggtgcactgtctctttaagggccagaatggtctgttttccctgcttaacatatttgtttgttcgtttgcatgaaaagggtaggaaagaccaaagcctggcagggaggtagaaaggaagacaggacagaagccaaccccaagggagtgagatgcacagagttccggtgtggggagcctgaagtggccccacagagctggggtctggacctggggacaggcttctttcttggtgcgtcccaggggaaggagcaattatatgaagtggcagagggagaaaggatcccttctgcagtgggggtgagctggcttctcatcatgcctactgcactggctgagtgggcaggaggccaggcatgaatctttctgatggtctgagaggcacagtgaccacgtttggtgagcctgccctaaacagaggaaagatgttctgtgtcacacctactccaacaacaactgaactggtctctagtaataaacaagaaatgatcaaactgccctataattgttgtctgagtctccttgggctgtcataacgaagtatcacaaacaggtggcttgaacgacagaaatgtatggtctcacagttctggaggctggaagcctgagatccaggtgttggcagggttggttcctcctgaggctgtgaagggaggtctggtccagg

SEQ ID NO: 63 - DNA, 2081 bp, Artificial Sequence
  Description of Artificial Sequence: Synthetic polynucleotide
ccacatgcatgctggcagagagggcggcttccagcagatgagggccccggagacacctggccctgtgcctggcagcgcagagacagtggcgttcattttctccaaacatcatgagtccttttaatgcactctccctggtgctggtcaggcggagttctctgagcttggcactgctggggccctggtggcagggccacccctgactcagcagcactggggaccacggggcccaaatgtgttcagtgcagagctttgaacagtcgtgggaggctccgcaagtcccgaaggggagaaacaggctgagcctgaagcagaaacatctggcagggctgtggagggcagcagagacgatgcccccaggaagatggcatgggggtggccctggctgctggctgagaccccgccggtgggtgtgggggacctactgacaaaccccattgttcccagggaaacaagtctgccctcattgcacctcctgggactctgcactagcagcagactttcagacagtggttagaacttttcctcttttctcccaaaatattttattttttccactttggtcactatttctaaaagacagatgcctatttctatgaggcatttttagtgtctccagggatgagtcaggggcctggcctcgatgctggagtcacatcttccgaggacgataggggggccacatacctccagctctcaaggacaccacatttgtgacaaaggcagaaacaaaatgcagaaagtgtcttccggtgccagaatgggaagccggacagggagtcggagaatttgggggcccatgcccagtacctggatcacctgggcgcctccctttgcctcctggcctcccattccacaaaggcgcactgagcggggaggactggggggccctgggattcccccgcaaaaccaatcagacaggagggcgatactggctccctgctcaggcctcagggggttcaggcccacgcgttgggatactagatgggtgcagaggcgctgctcgccacggagatgtgcggccagtgtgtgatggtgtgcgggtctctctgtctctccgtagagcagggaaaagctcttcacagccaactcctagggaatgacagagtgcagcactagctgagcacccaccgtgggccagctgctggcaaaccctgttcaccccttaggtgatttaattcttatgactgacccttaagggggtggtctgtttactgccacttcatagctgaggactctgaagctcagagacatctggtcacttgctcatggtcacacagctttagaagcactagagcccggattgaattccaagccactccaaggccaaaccctagctcttctccccatgtcaggttatgtctacatagatctatcctgacagctgtgattctattcagaggatgcacaatggacagacggtgtgagctgacgcggagctcaaggaaattggccaaggcaatgctttgctctaaattcagcctcagtaaacatttattggctgagtgcatgcacagatggaagaatgtcatctcctttgtcacgacacagagatttcacctgaaccaagtccgctggaacccccaggcaacgcgactcctctcctgcacctgcatctgctcccaagagctgacaaccatccacttcttgagatccagaaaagaacctgtttcaacaaatcaaccccctagattcatttgcttcaatcctcttgtaaaactaataaaaatgcaaagtattaccataattaaagttttaaaattataccaaaataagttaaatagttcccattactcatatcatttttcagaatgatataaaagataatatttactatctagcagtcataatgaaaactaatcttttaagcacttaatggattttctgatacaactcaacctgctcccccagttattcttaagcagctccaatttcaaatgctgtccttactgtagctggtgtcaggaattcccagatggcactgaggagaatatggatttcaggaacacagtgacagcggctcaaatcgcatcacccagggaggctgcacccacctgccagcgcctccctcaagctgcgat

SEQ ID NO: 64 - DNA, 2073 bp, Artificial Sequence
  Description of Artificial Sequence: Synthetic polynucleotide
gctgcacacagagcgcctctcctcctgcttcttgaccagccctgaccttgggaatttccttaagccatcttcattaagggtaatacaataggttctatccactctctcttttaaaaggtggtcaattttagtctttcccattagtgaaagaaggagagctactttaccttaatcattagcttcactgccaaaggagagcaggcacatggggtctacagggccttgtgcagactctgagctcaggcaggatcatcaatcatggagctgcctggcctgggatgctccctcactgggacatgtgacttgggcacagctggacccttcgaaactggctgggcactgctgggcccgagcccggagatgcccgcccacccacaggctcctggccggcccttgcaactgtttcatttactgcttgggacaattctccacagggctcaggaaagcgcatgctgctgccacactcggctccgcttccccttccaaaccctaatgaggtgagataatggatgcaggaaagtgtgcaaatgcaaatcaatatggaacatatgctccaggttcctctgttacctcagagccaggcagagagagaagaggaaagactttgaaaatattttgagaccaggactttttactctgccctaaagaataccaaaaactgtgaaactgtagcttccttgctcttttgcagccctggaccaggagacaaattgctaattttgatggtgtctcaggaatggctttactgctcacctgtctttatactacaacacaaaattaaatcatccaggaagaatgaggaacaaatatttggcaccaattctcctatttcacttctgcgaaagtctcagtatccctttgagcatggagacggaggccttgaactgaagaggagagccggccataggcctctggatctccccagccaggcctcctgccccctgcattttgactcaagtagcccaggcaaaaggccaggcagagctgggccttctgcccgagccattgcgtcagtgggctcagcaggccacactgctggccaaggaggtctccgctttccggagtccaggggatggagaagctggcatggccctctccgcactagccaaatatcctgcagggggagcttttgaccggacctttcagggcttacatcagatgctgaacaagcaagggaaaggaagctagcatttgtctgggctgcctgctctgtgccccatcctctgcatcccagtatggtcagtgttctcatctctgttgacaacatgaggaaacagcaagactccaggtattcaagtaaacagtggagacggaaagaaaacccaggtctgccagtctccaaacatgtactctttctgctttacaagaaggcatttcctttgtttcctataccctgcttatggtcatgacatacgtcaactgagcactcaagaaccagaagtccccaaaatcattagtcaacaaggatgaatcagttccctgcaaaggcccatcttttctcctcacagacctcatatgttttgataacggatcacaggccctctgtcattccatctataggcccttaccttaacccaaatcactctttagcaagaacagaaatgacaacagtgacaagactgacctcacaagtatcaaagcctttcaacatgtagcaaactcctatttatccagaactctcagaaaaggagtagagggtgctgtgcagaccagctgatttcgtagacagccttcaagccctaatacctcttactggctgtctgaccttaaccaagttactttcctagaggagctggagaacctagaggacttggcttcacatccttcatgacaatgggataatagtgactgtcctaaagggttgtcaggaggattaacaaaatatgagccggaccctgaagatagaccatctcagctcctgccccttatccactgcctggtagtcatacaaccttgggcacaacacttaaccactctgtgcctcagtttccttgtctgtaacatgagaacaagaatgccttctacctacttcatagcattgtttctaaaacacttagtgcagttgctggtttg

SEQ ID NO: 65 - DNA, 2066 bp, Artificial Sequence
  Description of Artificial Sequence: Synthetic polynucleotide
gctgcacacagagcgcctcaagtctctttaaatttcaactccaaatccttgggatgtaactctcagcccagagctatatataaaccccttaaaatcagccacttgcaacattctgagacaaaaactgacttgggaagaataattcacacttctgacctagcaacaagataaatctgctttcctaaaaacaatcagtttggccataaactggtcattttttgtgggtgcctttactttatgccaatagatcattgtctaaaatctcgacgtatgctgtttttcaaataataaaagtgcattaattattttgtgatgcgttataacgttttctgctatctttttttatgacacaaatctaattagtacatattcttgagagatctaaagtaagaaactttattaaacattttcaaacttcttcctgagctagtagaagagcaagccaagtgaatttcaagtgacattaaaaataatcacagcaaaaggcttgagaaaaggaatgacatagtcagctttaaatatgtatattcctatcacatgctaatcatacttgcaaaaattgtagaattgcttatttggtatcattacttgcttgaactacttactacattcttgaaggtaattagtcctcagtaaccacacttccatgtattcttctttaaatagaatacctttgtatctaaagttagatatagagaagttaccttctttaaatagatgcctttatatctagagttagaacttaaagagaaatatctccataacagccaaaaaacccagatgtagcgtattactgtactctactatgttcatatttttttatttttcaacacgtaacctaacaggaaagaacatgtaaataaataatcactaaaacaaaatcatgttagattttcatggctcaaaaaattgttaagagatttgaaacaacaacaggtctttgtcatttaagaatacttggtgtctctgaaggttcatagcaacagtttgtttgtctgcctatcagtatcagtttacatgctcaagtgatactgaattttctctatttatctagtcacgcttctccccacttagatgctattttcaatcatcttaattctgatataattcatcacatatgataaattgtaagttccatactgaacattaacctgtaatcctacattccctacacacaaagaaatatcttgcagaagctattgcagaacctctaaaattaaaagggaagttaaaagttaacaaaatctgaaagaatatgttgaaaggttagaaaggatctaggagttgtgaaagaaaagaataggtgaacaacaatgaatatttaactaacatttgtcttcaacaaatataattatcatttgccttcaacaaatgtaactgggtctgagcaaacttatagatttacaatgaattccttaaaagttagtgtaaaagcagaaaccagagctgtcgctcccattctttcagaatgttttgatgaatcagaagtttttcttaaaaatgcctcaaagagtcaaaagatcttaactatattgattatttaatttttcactatctctttaaattttaaaagaacataaaagtaaaaaggagaagccaaggattaaataaaatatttgactatttattcagaaatacttcttattactctattttattttccatcttaattctgatttatatgcttttaccactgtccaataactaataaataagttaatgagatatttaaaaggtaatatgttttcttacacttttttcttttgattcatttactatttcttgtagttacagtcttgttttattaagcactttgagtctacatatcattttaatggaggtgtcaggtgggatgtccttctcatttaccctacaatgaatacccagacattcatccatcctactcagtcctaggcagatatgtgaattaattccttgtcacccacgatattccatcttcattgtttttcttcctcaacccccaaatcattcacatagtttcccccaatagcatccattttcacaggagaatcagtggcctcctgcatcacatcatcatctcttag

SEQ ID NO: 66 - DNA, 2049 bp, Artificial Sequence
  Description of Artificial Sequence: Synthetic polynucleotide
aactaacttgcttgatgactaaatatgacagaatgtgattttattcaaagtctaccagaagacagacgagaaagatactcatgattggtccttggagagcaaacaagaaagccactttgaccaaagtaaattcttaatgcaaagtaaattcatgaatgtgttcaacagaaatgaggcctcagttagatgaaagttttcatggggctacaaactctaaatcccaagacattttgtataacccattaactctaaggagattttcaaaagcagaaagagctttcttacctgtgctccagttctcgaatggacagtatcactcctgaagtagatggcttctgctgtacagtggccaaaatggtgaattcactcttgttccggaacagctgaattaatttctcactcacatgaggagctgcatggatctctctttctatgtctaggaatcaagaagaaaagcaggaggaaacaggagaggagaagaggaaggagaaggagtagagaagaaatataggagaaagaggagaggggagatgagaaggaagaggaaaaaagatccatggttaaaaatgtcatgtccaaagaatccagattgcaattttcattttcctcttctgtcaatagttttcattttcaggcaccattccccactccctacagctgcattcattcaatgcaaatcccggaaatgctatctctgtcaccatgcccacttgtcactttgacaagttcccaattggccagacagtgattttctggcaggaattttgacgggacgctgagcaattcagtttgctgcaaacagattaggttgctgtaaataaggtgagaggtagtcggataaatgtggtcctaaattcagagaatcttgggataataagacccaaatgccactcagcatcctccaatttcactttttccatggacacagcttccttctccccacaatggatataggaaacctgtccttgccttgtacctagcagatatttactagcactaataatgccagacaactctgcctttgcttaacgaataaatacaaggcatgctcatgctccacacccgtgcctggaatttctccataagcatgcaatggatgactttcctcatgaaatatttattgaagttgaggccgattcagcaggcctagaggtgtgtgattccagctaatcctgctcctagacaagaatgtttctttctccaacatcagcataacgagagacatccatcacttcatacccagactcacccttgtcatgataaactgggtgttatctcattattttacactacatttttctggcatcagaaaggggcactaagggagcaaagttagagaagattattcagaggatgataaatgaacattagaagtgtgtttggtgacctcctctcacatcctgaccatctcctctgactgcaagataactacatggttatttctccaggactacatgggaagcccttgaaaaacatagaacttcaaatgctgcactgcccaagcaatatcacagactggtatacggaccttgaagaatctcatcctaaagaatggcttctgaataagatatccttcaattcttgacctcgggcctcagtcccctcatctgcaaaatgagggggtagactaggtgatctcttagaaccttcccaccttagccttctataattttttgaattgctgcttcaattttataacacagaaaagaacagcacagtctttcccgcctgtaagtatctagggtatgaatcgcagaaagcaatgtttgtcctccaccatggagacacccaacccaggcagaccagtctaccagtataaaacctacctgcacaatagtagcaaggccttcgctacttaattcttaagtggcatgctgtcagcttttatcaagtgttgagaaaagagatagcatcttgaaaaatgcttctatgccttctacaaaatcccagccaaagatattccagatgacatttaaaacctattaaatgtgtgagcaaatcactctgtaaactaaagagtattagaaaatgtttgttaatattattttt

SEQ ID NO: 67 - DNA, 2037 bp, Artificial Sequence
  Description of Artificial Sequence: Synthetic polynucleotide
gcgctcgtgtgcagctcaggaggtacaggatgccttttatcttcggcctatggataaaaaccatttgccagtgttcccctgggtagccttccagtctttgagttctaggcaggagatgccattgcttgaaggaattatttttaaggcaagtttcacaagcattaacaaactgtttgatcatttttagcagatttttacttgagaacaacctttgggtcaattgataggttttatccttatctaggtggaaggcctggtgaagacttttaagaactttccattggttggcagctggtagatgaaacttgctgtcctctgatggtagctatcctgaggactaaaagatatatccttgagaggtggcccattctatttccgcaggagaatattgaggtttatttctcttatggggccctctcagatcagtggggcttcaaatggatcagaaacctggggtcctttcactgctgacttaactgcttggtctgccaacctgtttccttcagctatttcatccatccccttttggtggcctttacaatgaattactgccacttcccatgggatgaaaactgaggataatagtctgtcagtttcctgatggtatttgatggtagacccattatctgtgatgaagttcctctttttttccagataatgggatgggcatagaggactaggaaagtgtacttagaatcagtataaatgttaactgctttccctttgcttaattcaaatgcccttgtgagggcaattagttcggctacttgagcacttgtgcctgaggagagagatgcactcccaacaatattaagagtaactattgcataccctgatttatggatcccttgttctacaaaagaacttctgtctgtaaggagaatccagtgtggattctctaagggggtttccctgcggtcctctctggccacataggtttgtactactatctgtttgcagacatgtacaaactccccagcctcctctcggaggaaggtggctggatttagggaaggacacatacttagttagactgtaggtcgctctaatagcagagcttgatacctgaggagatggttttccattagccagagactccccatagaagacagcggtcctgccacattatgcagagtgtaaatggttaagttagtccccatggttaacttagtagcctctggtaccaacaaggctactgttgcaactgcccagggacaggctggtcattctttggctaccaaatcaagttcctttcttaggtagcctatgggctgctgggctggaccctgggcctgggctagaactcccagggccattcccctcctttctgacacataaaggttaaacgtcttccctatggaaagactaagggttggtgccttaagcaaggcttcttttagttggtcaaaggcctttctagcctacagttcacaaataagacagtgagttttagctgcctgagtctcctttattaggtgatataagggatgcgctatctcatcgtacccaggtatccataatctacagaatcctgtaatgcctaagaatcccctcagttgcttgagcattttgggtagagggaaggaggagatgggcttaatcctttcttcacctagttaagaaaggttccttctgacaaaactagacctaggtacttcacggaaatctgatggagctgagccttagattttgagaacttatatcctctgttagccaaaaaattaagaggaaccttactgttctcctgagagacttcctcacttcctcagttggggcacaaagggtaatgtcacctatatattgtaagactttaacatgaggataaaggaagtcagagagatcttttgacaactcctgcccaaactcttgccacatgtgtagcgttaacaggtgcatcttggggattccggggtttgtaagcctgccaggtggccattagaacctctgccttttttttggtgctgtcttggaattcctgaggtaacactgtccaggttagccaggtgttctggttggagagattcttaaatatgaaca

SEQ ID NO: 68 - DNA, 2037 bp, Artificial Sequence
  Description of Artificial Sequence: Synthetic polynucleotide
gctgcacacagagcgcacggtctctaaatgccacacatttaaaaatgtccctttagtgggttgaattgtttcttccaaaaagatatgtttaaatcctaatcctagtatctgtgaatgtgaccttatttggaaatagagtctttgtaggtgtaatcaagttaagacaaggtcatactggattagggtggaccctaaatccaatgactgttgtccttataagaaaataaaattcagacacagaaaggagaatgctatgtgaaaactgaataagagaataggataatgcatatacaagtcagcaacaccaaggattgctggtaagtacaagaaactacgagagaggcatgaaacagattatttttcagagcctccagaaggaaccaaccctgccaacaacttttagatatgtagcctccagactgggagagaataaatttctgttttagccaatttgtgatatttgttatagcatccacaggaaactaatacaaaacacacgtgtgcatatatgaggaagccagattttcatgaaggaacatcagattgcagttttgcagtgcaaacctggactcaaatattgcccccatgattacttgcagtgttattctgaacacttattctctctgacatccattttctcctgtgaaacttcagtaattgcattatgaagaataaatacaataacatgtaatgaccagaacctgccacatgataacagcactacaaataataaaggtagtaacacttaacattagagctgaggttgcatgcagcacactcgatagcaccaaacagtctttcctaaagtaaatcaacagcttgacacagagccaggcccagaacccaagtacctgattccatgtacaatgtgttacctctacgttagaaatctaggatttctctaatttatttcctatttttcttagggctgtttggtttcttccccctattgttagcagaaaatctctatgtaatgctcataataattccaaggaaatgttcttctcttaatttgtggctcaaaccggtataatttcttctttctcaagtctgctgagaagtactgcatcaatggtcaggacatggacacaatttccacaagactgagtttagagtctaccttgaaatgaaaaatggatctgatatttagaaaatgaaaaacagcaagctagcctgtggctaagcaactgaaagttccactctggcacaagttgcttggtatgctgaaaattcttccatcttaagatttgaaagacagaatgaagacctaggggactttgttggttccagtgatctatcaagcaacttcaggaagcctgaaaaatttggatcatttggcatgtataatgccagacacattcaaaccagtgagatagtaaatcaatattccctttaaattatgagacaaagtagcaagcacaggagcacagcacttccagaataagagcacccaccagaattatcatttgcacaaaataccagaaactaaatgttcagaccattaaattgcccatcacaacactctgactggataaccactacaacatatgtaggtatgtatacatttaaaaacacataatgtatttaactgatgccagcaagaaagcactctatttttaatacaatgtcaaagaatgaaatatttatgacaacatccattgatgctagtagtgaaatcagtcattaaaaagtcattaattgcttattggtatgagacccagtgcttctaaaaaccccataaaaagattctcatagttcatgatttatgcattagtaaagtattacagtcaatgtgagactatttgtttagccccaatctgtctatccttcatgcaatatgtccgatcgctaaaagaatatgtaatagaaggccattaattgttcggtattaaaatgctttagaattatgaagaagcaatatcatttaccaattgtttcaaacttaaattgtacaggtattttcatttaattacaactactatttttgattttgatattttctcagcagtggtatacttcttgcttgtcatattgcag

SEQ ID NO: 69 - DNA, 2036 bp, Artificial Sequence
  Description of Artificial Sequence: Synthetic polynucleotide
gctgcacacagagcgccagaagttggattgaactgagagaagttgaaatatgacatctttgtgcatttcctagactgtatagatgctgtcccatgccttgttcaaggactgggtgtattaccccagtggaagacatgactgtgggcttcaactaaatgcccagtttttattttatccaatttgttttggtttcttctgcttgcaaacaaagtgctctaactcaatggggtgacatatagtaaaaaaattgctgagctatacctaaacagacagaaaaggtgccaagaaatgagggaacacctaacgtgattcctaacaactttgctgaaaaacttatttaatcctaaaagggtctcatggtaaggatatttagtaggtcctttttacagaaggataaactgaggctcagctaattcaagtgatttggacaagatgctaaagtcagtaagttttggaatcaaagtgtgaagccaggtcaactatattgaaagtatgaggatgccacactagtccttaaagaatgacaaaggtggtatatgacatgtcacgtctgaattccttgactacaggttggtttatttacagatcatagggacatacttatcaaattaactgaaatagagcctgaaatgtcattcaaatgcagtcagatagggatacagtccagcaaggacaacctatgttctccatgtataataagcaattaaatgagtttcttgttaattcaatcagagagggacagaaatattgaaattccttggatcaagaaaaaaaaagtttttaatgcagttgacctttgtcattttcatgtaagagaaactgatgatgagccactgaactagcaaattagctcttcagagatgttgacagggtcagtaagaaatgaaacccatcttaacaaagatgagctggtttcttaggtgtatgacccagttttgcaggctttagccatgaagaagttcagaggaactttgaaaacagactttaaaaatgtacagattttatttgttttatcttgagacattcgactcttttcttcccattcgaaaaccagtgaaatgtaaaggatgggattgccaaatcttatgaaaggtgcagttgttttatctttttcaactgtttaaaagcaaacatttgaaacgctgggcatctaaactacatcaggcactgttacttccatagatcatttactcctcacatgagaagaggaaacattctttccaatttgcaaatacacaatttagaaaccaaaaattttcataacttgctacaatctctttccctcatcaccatgttacaatttaagatcactgtggagaatgtggggtgcagaaataaggcaaaggttagtttgaagatcatcaattttattgtttatattttctgggtacaggcttgactatagttcctatacttttttgagatgggcatggacctctgactgagttctagccaatggctctaagcagaaatgccttgtagcaattcctccctggtctataaaatactcccactaacaatttttcttgtttccctcattccattggcccgatagagacaagtctgaaagtcctgtgttaaaggtagggtagtgcaagatgaaaggtgcctgggtcccggaataacatggagaagagccattcaccaattgggaacatttattctggacctcaaatggcaaaacataaattgtagtgtacttgaatccttaaggcatttgggaatttactaccgcaatcagtgtcaacttagtagtataaaaagctaaagaccatgggggtgatagctttgttggtaggattttacattgaagcatggtccttaaatgtgacaattgattttattaatatgtggcaacttggctagattctggtgcccagttgtttgatcaaacagtagtctaaatgttaccattaaggcatttttcagatgtaattaacatttataatccattgactttaatgaaagcagcttaccctccactctgtgggtgggcctcatccaatcagttgaaggctttaaatggaaaaaccaag

SEQ ID NO: 70 - DNA, 2031 bp, Artificial Sequence
  Description of Artificial Sequence: Synthetic polynucleotide
gtgtttatccgttgacccatgaaaatctaatattctatcagctttacagtggtgagaagcactgctggggggtgtccccctgccagcttcttcagccctaacaaaagggagagaagccttgtctaggaaaacccctctgagattgcttgcttagctgtccctgagaattgaagaaacaacatttctcatatccactaaagccttctgataatgaactctgtgataaggggactccattcatagtgaagccacaaatcattccagtgcatcaactttttgcagtcccaagagagataaagagggaatgttttggagttctttaaaaacattttgtgtgcccattgtatctcagacctagtaagctcgaaacacacccatccagcaccttgggggcactccaggtccttgagatataaaacctttaatcctcacgaaaactcaaggtagctgtcaatgtctcttacccatagtttccacacctggaaaagggggataagtatcctctccacagctataacggccagtgagtgacaaaaggaggattcaaacccagggctgtttggcctcaactccagctctggcctctgcgtcctgcctccagcctgctgctgtgcccgctgagactctgcttgtgccttgtcctatctcccaccacatctcccacctgtccagaccctcccatccatccttccaggcctgaatcaacaccctacaacttgcctgctatgaagtctgccccagctgctttaagtttttctgctccctccttcaacaaaattttttacctcttatcgtgtgtttgtattcttctctgttcttgggtcttattcatttccccaggatagattataaactcctctgggtcagaatccacaccttatatagttattccacttgggatcatcatggaagctgccattagctctagctgcacagatcttctatgcgtgtatcttttcctgcaggaaaaggttggcttgctttatcttcagaccttcttggttacttttttttttaaaggcttgctacaaagcttcattcagaaagttcaggagcaggcctcgcaactctgcaactccgggttaaccctgaaactcagctatctgcctccctctgcagcattctctctaaactatgtgctagctgaaatcactctcaccaagaaagtattcacatgaacaaattgaatggggcagggggttttttctgctctgttcattggtgtacccccaggacttagaatagtgcctagcatctggtaggtgctctaaaaatcttacgtgaatgaatgagagaatgaatgaaagttgttgaaagcacttcaaatttcagatgactatcttaatgagctgttcattaaataaataacctaattagccgtaatcaagtggaacccaggtgtcctggaccctgatcaagtgtggaaagtccaactctgaatgtttggggtgcgtcgggagagtggtattcttaaacactctccctggataattctgatgctcaccaatcaagagccactgtcttacagagaattgttagttattggtagtgagtctggcaaaaggctgtaagtacattggcagattatctgcaggtacaatcctcttgacaggcctaggcattggcctcagtgatgcctgtggcctctgctcaccgatgtgtatgtgagagttcctgcctcctctagtgtcttgcaaagtctggcctgagccccgtccaaagcacctaatgccatcgtacctgcgaagcagatggccaacgtgctcttaattggggtggctgtatccatctaattgggaagctgcctggaagaaccatctatcactcctgccggtgacaaatggcaggaaggagcagcctcccacacaatggccctgcccactcctgctcctccacaccttattatgcctgagaaattaatattcatgttgttttgtcttgacaagcagggcagagtgatgtcaggtagttgcttcccttgtcctccttctgcacattcccctgagcggctctggtagggctgaacctctg

SEQ ID NO: 71 - DNA, 2026 bp, Artificial Sequence
  Description of Artificial Sequence: Synthetic polynucleotide
tgagtgttttaagactaaaaaatatttgaaccagcttctgtaagtaatcacaacttcaaagtaaaattaaattacaatatgaatgtttttaataaaagtgtcaaatgtagttttatgcaaagtgaaaattaaatatataaacatttttcttgaataaatgtataataataaaagtatattgctaagtaatatgaactaatatatagtgaaaaaataaagtaaagggctaaatagatcatttaagcagtcatatgcattgtaaaagataagagaagaaataaaactctaggtggtaaatttatttcttactacaccttcaggaatgttatttggtaatttataaatctattaaagtagaattgctagtaatggtgtgaagtaaattcagtttatttcacaaagtagaatgaattagtttatttcatggtcgttttaggtgtaccataaagataatgaaaacataaattttattatttggtcagaaatcacttttattacttttgattgatagtgactgtaactatcacattctatagcctgatgatcatcttgggtttgtgctctgaaatttgctttgaaacagtctttggaatataattacaccaggcacaatttgaattgtttcttttttttttccttgtgtaaagttacagtacaaaatcaatatttttatgaccaagaagaaattgaaaacaacatatgaatgcataattgtgcaaattaagagttttgtagtgaaatatatgttgagatcagggctgataccagacaaaactgggatatttctaactttaattgtggtgcactgtatgcactgacttaaagccttctactccttcttggctagacattgctttctgtaattagcctttgtgccattttatgaatcagggaacagaaggccgtcattcacttagtaatctttctgatagggcattgctatttttaactgaggactttatctattcaactgagtacctgcaaaatgtgaagtactcagtcttgtgtctgggggaaatggtgaagaggacagaaagtaaaagtggtgtatagtaattactgtagaaggcagatagctaagtaggcaaatatggcataccatgacaaagttatggaaactgtaatagagtgaacatataggaaaagcatctatcaaaacaagatgggctagggaaggattcttaaaagaaaagggaatattttcttggctgatatcagtataaaagcaagccaaaaaataaagaaggaggttgagagaaagttcaggaaagagattgtttaattaatttcttgttcaaagatacaataataaaaatgtagtcaaataattgcttgataggtgttagaacatatcatgcagatactaaatctttgaaaaaccctcacaggaaagggaaagtatctttgtatctgtgggctactataacaagtaccatagcctggatggcttataaacaacaaaaatttaacacagttccagaggctagaagacagagatccagtgacaggacgataggatcctggtgatggaatgcttcagattgccaattgccatcttctcatatccttacatggcaaaaagagaactagtgaattttctggagtttctctcataaaggcagagccctcatgacccaattacctctcaaaggtaccacttcctaatgtcacatgggtagttggaatttcatcttgtgaattttagaaggacacatatatgaagtttataacagaaaggtttctttccattgacatattttttaaatattttatatattttgattaatgaatatgagtatttaataataaataacttcctttatttaaatgtaaaaatcagcttgagatttggacattatcaattgcttaaaaaggagtacagagcacctcatgttctaatacgttggcaaaaattaactacatataactcatcattattttataaaagattattatggtgttttagagatgtttttgtttgttttgttttaatttgtttttacaagcaagatttctaagtgttaat

SEQ ID NO: 72 - DNA, 2014 bp, Artificial Sequence
  Description of Artificial Sequence: Synthetic polynucleotide
ggatagagtataatttctgttttaataaatataatttaaatggaatctcagcattaaaattcctttcgaaagaataacaaaaaagagaaaaaaaatgttccagtaaatggcattctatcattggtaacgtgcgtcagatcccataggcttttgggaatttattgcatttacttgattattacacgagcatgttaaagccaattgaaagaaaacaaaataaaaaaattgatacttcactggcctaacttaaactgtgctagaaatttgcagtggcatcggctgctacagaaatggggcgatacaggaatagttaactatgtaaaaatgcaatacttactactacatttgtgaaaatagcatataacttcccattactaaaacagaagttacataaattttttccttttacattccttatgaatggatttaggttttggattacctatataaactatctcaaatctattgctttacttaactcactggtagagacttataaacatattattacagaagaaacatagaagccaataagaaccgaaacactattgagtataaatatcaaattattagtaagaatgcttccaaatgcattccactatggaattcaagctgtctttggttttcagattattctccttcattatattattggtttcatgttattattactcatttcaccatattagattttatattatttaaagtgaaatgtgtatcatgttcatctttatattttgtttttatacatcaataagaacatacctagaaaaatgccttgtatagcttaagtgtctaatcagtgtatattatataaaggtgaatttcaatatgaataaacccatcaactattttattttagtctctaaattgaaaaagctgttctttgtaacatggaccagtgaaaatgaagttacataaaatatgtgatgataataatacaatatttaatattatatataaaacaatatcaacacaatttaatgtcagatcaaaacaacaacagaaattcattagagtaagaagagaaattgagaagggtgaagtttctcgaatacagaaaaattgtgtatacatcctcctagatttagcgaggcatccctattctgtgattcaccattggtgaatgattaattaagagttgatacttacagagagtaacttgcctattttggtctcagtagtcatatggtccttccttttactttgtgtatgaaacatccaatgtatccagagtaaagacaatcaatttaataatttgtcttgtggagccaaacagaggttgtttagctctctatcttactatcattttccattttcacgacaagatttataattcagacatgctgggtaaacctataacatgtggctatcttgtactttctatccccaaataatagcaataatatttgtacattttcttttggatctttcatattgcctcagttaaaaaacaaacaaaaaaggcattatcagcaggaacaatgtgggtgcattaggcaatgctgaaatggaaacttgctgaaggatagcttatatgagcagagcttgcagaatagttcccaagagtagtatcatagaagatagaaactcaggtaaattcttctataaatattttaatactaatgaaaaaaatcttgaaatttgtcccatatttctcaggcagtagccgtaagtacagagagcataagggaacataattcaagaaactgtgaatacaaattttgttattctaactctaaactcatgatttggcagtaatctagtcttaaatttcaaaggaaatagctatgattttatataatttaaccctcccttgaaaggtaaattcaagttaatgctatgaatcagtagattacaatttcacaaatgaataacagttttgtaaactgcaaaacacaataaaatcagagatttactgctttcaaagtctttacaaattattattaattattttattttaacctactactactcagctttattctctgaatgatggggtattttctacacc

SEQ ID NO: 73 - DNA, 2013 bp, Artificial Sequence
  Description of Artificial Sequence: Synthetic polynucleotide
attatgagaacagcatgggggaaaccacccccatgatccaatcacctcccaccagggagctcccttgacatgtgggcattatggggattacagtttgagatgagatttgagtggggacacagagccaaacaacatcacatgtgttgggatttaggtttccatggatgtaaacattaatctcacccataaagaaaacagtttattttcatcccaaaatatcacacttcattgtacttggcatccatatgtcacaatatgaaagatattgtattttaatgaaaaaaagtaagataacagccacctcagttacaggctttgagaagtggcaggctactttgtgtcaagtttgagatccaagctctggtcattctgatcaaagtacaatcattatttatggactcaagtaattagtgtgaaagacaaatgactattataattcaaatctctttcaaaacgtttattattgaaagagaaaaagtttgcctttgtcattaaaaaagctatttaagaacatttacacatattaactcattttattcttcttttcccttattgttttgtagaactgagaccattacttgtgttatacgaagcaagattggtgagaatatttcagaatcattagtgatgggactggagccatcactatatctcttgtagtatctttaaattactaaaccagcctgagcatttagagacagagtctgttaaaaccttacattcaagccaagtcctacattcaagctaagagtctgcttgaaaagaatttgtacaggtttattccagggtatcaggtttgttccaggatattggttttcccttttccatgatatatagctctatgatgatgcttcctactcctgcctcgtctacttcctcttttttaaacctcctttcagataccacattcgcttttaccttaaaacttctaataacagcaaactagaagtaatgcaaaagtcttgatgcattaagtagcaagggaacaaataaggttgttgtgctatgttgtaaagaacaaggaataaagacaaagacataggatgaatcaggatacatacatatggacttatgtcctacagttaagcagtgcttttattgtgcattattgttaaaggttaaaagtataagcattaaagcaagtgaggcatgaggctgctcaggatgatcatatcagtatacatcaaaagagcttacctagaggtgagaaggacgaactaatcattaaatggaaactccaaatcagaatttaagtttatcctctttctttaatgtcgcataagggcaatgggccagatactaatgttggcaattcaaatatttttaaatgaactttcttcggttgattttcttctctattaggatggactgttgtatctacagtgccaactgaagacaacattttacattcttggcccttctgtactaatacatctgctttaaatgatacctgcgatccagtttgctgtctttctttttttagggaaatcatattattcagttatttcaaactgtgaatttattttctccagagatacagtattcaggctgttactttatattggaagagggctaaaggacttattctctgactttaagtagaggagaagttattagttggagtgatgagagccccaggcatcatggaatcactagatagcactccagtttactgattcttctctggtcaggatctcagccttaaaaacagtatgtagcagcttcataaatattaaaccctatctggcaattaacaagtcctggtaggaagggcgatttgagaaaggggaattactactgaaggacttcggctcctctcacatgaggctattgagctaccctgaggtttgtttatggacttcagtatcaagaaatggccagggctgttgacgtgatattgtaatctgaaggtacaagtgacaatggtctcaaggcaacagagtaaaagaaaatgttcctttaaagaaagattccttcagtctatcaagcttagcctgttgagagatcaaggca

SEQ ID NO: 74 - DNA, 1995 bp, Artificial Sequence
  Description of Artificial Sequence: Synthetic polynucleotide
ggattgacatgagtgtatgcccatccctgaactaatattcatgttcagggagatggagcaccgcaggtcacatatagatatacgaattcacggagtgatgcgggaagaacctgacacctctgttgccccactcacccagctcagtgttctcctggtaagcctctcacccacatcctctgcctttgtcttcacagaaattcttatctctggacttacagggagaccccagagaggtaaggaccttttgtttctggattacgggttttgagtcttagcacctttaagctccaattaactgtgagtgaaagaatcatctcttgggtaattatagtaactcctgcgtgtttgtttctgaggcccagagaggggtagtgactcacctgggtaacacagccaggaagactagtggctggcctggaacccattttcctgactcccagtccagtgctcccaggcatcacctctgtgtgccctgggctctgcccactccccttcttttttacattttctgctccccaaaatggcactgtaggaggaggctgaaacagaaccttccacaatcaggaggcagagataacagcgatgattagccaaggagaggggaagcctaaatctcagtccaaggacactcgtctcctcccagcacacaggaaactccaacagtattctcccaatctcctcatccccactcccacccccacctcccagtgggttgacagtttctggtgacatcacctctgacgaatcttacaatcctgtcctctctgctgccttcctggaggtcacagcactctcctaaatggtcatgggcggagtacacgagattcatccagcaaagacttaataaacacttcctatatgccaggacttgtttaggagctggtgatataggagtaaaacaagaaagactccctgccctcttgggaccttccattacagtgccaggacagtgcaataaaaaagcaaatcaagtatgtattccgtttgatggtgtgcagcattaggggatagagtttgtgggtggcttcaatttaagtagcaggatcagggaatggttcaatgagaaggtggcatttgagccaagctctggaggaggcaggaagccagctgtcaggaaacctggagaagcctattccaggcagagggaacagtcactgcaaagaccctgacagaaggggccagtctggctggagaggaccgagtgtggggacagactggcttgaggctaaagaggtaatgggcagtgggagagagatcaattaaagtacttggatttggattcagagcaagatgggaagcctttggaggttttgaacagaggagtcacatgatcttagatctcacaaaggtctctgtctctggtgttcaaatagactgtaggaaaggggcaaagtggatgcagttgaccagctgggcagccactgcattgccataatccaggcaagggctcctggctgcttagacagggctgtggcagtggggatgggaggagtagttggagtctggatatctttgaaggaatagctgacaggatttgctgatggacaggatgcaaggggtaagaaacggggaggagtggaggacgccctgagttttctgacacaacaaggttgtgcccacacagggcagccacttgcaaactctaagtggagaacaatcacttgtcattgttgctgatggcagtcttccagcatggctgtcacccaactgaggtgctcccgtctcttgcctcaacttttagcctcttctacttcaccttctctccccatttccatgtctcatggtgcagccagactggccttccttaacagaattagagcacgtcacccccacttcttaaaagcctgaccttccttatgagacaaatccccttccctccatggagttagtccttcaaaacacacctgcgtgcacactgtgtgccagactgtgcagaaggtaggctctgcacctgtccctccctctagaccctgccccacagcatttctccaagcc

SEQ ID NO: 75 - DNA, 1989 bp, Artificial Sequence
  Description of Artificial Sequence: Synthetic polynucleotide
gctctggcaaaactcagacagaactcatggaaaatacaaagttttcatctgtgtgtgtgtgtgtgtgtgtgtgtgtgtgtgcatgcacccagaaacacacatgtaagcacacatgtagcaatggtttaaaagaggacttttagagctctacagtcagggtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataatagcattacatatataggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagat

SEQ ID NO: 76 - DNA, 1984 bp, Artificial Sequence
  Description of Artificial Sequence: Synthetic polynucleotide
aatagaatatctgatcaccaaaatattgcaaggaatattattatttatccttatctattaggaaaagaaagctaaaaggcagaaattctcaagttattttccaggtgactgtttaatttacctaattatgagaaactacacgaatcttcaaaaaatagcttctttcttaagatttacaataaatgaaccgaagtattattgacagaatactataataattaagattggtgtaaaatggttgagattagccaaactctcagttaaagcaaatgagctaagacttacagaaaaagtaatctgccttaaatgccattttctctttgcttggccccaaatggctgaataaaaatgctgaagcttcagtctctttaatacagaaatagacttcagtatctgatgctatcatcaggaactatgtatcttgtgtgagtgatttttttttgctgtgagaagcaaggtgtattcattgcctatttctgtggaacaaataatccctgaacttagcaacttaaaataataaacaattattgtttcatgatttctttgggtcagggatctgtgtgtggcttagttgtgtgtttgtggttcagtgtgtctcacaaggccgaaatcaaggtggtggccagggccacagacctttcaaggctcacctgggagaaggatctgctttgcaggttattcacctggtcattgtcaggcctcagaggacccatttccaggctcactcacatgcttactgtcaaacaccaggattttgctggttattagctggagatctctctgagttcatttcctgctgtgtggcctttccatagggcaggtgaaaatatggtaactggcttccctccgtagggcaggtgaaaatatggtaactggcttccctccaagcaagcaatcaagagaagaagagagatcatctaagagagaagcaaaagtctaacctcagaagtgccatccaatcatttacgctgaatcctgctccttagacgcaagtcactaggtctagcccacactcaaagggaggaggtgtgacaaagaggggaatactaggatgtgggtggggatcactgagggtcgtaatggaagttacctactacaatctggcttcacgttttagttttttgaaaaatcattcacacactccaaaatcccagttaatggttttgtagctcactgcataatcctctgatttgttcttaagtttttagttgtctgtatttattattataagctgcagcatttttttatttatgaaaataaagaaattgaaaacacaaaggtgttgcagaatgtgggaaatctatacttaacaaatgcatggaagatgacacaaaatcccatccacattccatttctcttgtgaaatttgttacagtggagggaaaataatgctatgctcaaaagcctataggtaacagcaaacggtccaagtcaaaacagttctcatctattcttcagagggtgtctaaactggaaatatagttgacattttgtattaagtgcaattgaattggttcatggttttcctctttacatgaatttactaatactgttgtattacaaatggtatattttataagatccatagtttactttgtttttatctatctttggagagcaatcaatagacatagaagcagataatcagaaatgtgaggaagggtctttaggaattacatatatatttgtttctataagtggaaagatgttactgaaaggcaataattactaatggaaagagctcagtagctggtttttaatatttcaaaatcgctaatggaaaatgaatatttagccatgataaaactatatagactaaatgattagtttatttgcttttttctgtagttctatcactgaaatatgaaaattgtcacgtatctgtagttctcattagcatatatttgcagatgtgtgtatatatgtgaatatatatgtatgtatgtgtatatatatttgtgtgtgtgtatatatatacacacac

SEQ ID NO: 77 - DNA, 1965 bp, Artificial Sequence
  Description of Artificial Sequence: Synthetic polynucleotide
tgaactgaattaaaaaataaaagtacaacataggaaatttacatgatgcagctaaagcagtactaatatgtacatgtatagcactaaatgttatgttagaaatgtcatcagcccacatcaggagtgcttttcaggatacctagccagcttcctggaaacaaagtcttcactattagcttttttataagttcactttgttgttatactttttctttttcacagtatgaaattactttcttttcttatatttccattcacattattttttaaatttattttttggttaactgaaactttaaaaaacttatctggtacaaattcaaatttaaactttttgtggatagatatttaggatagtaaaaatagagcctggtggtgaatagaaatccctccagagcagcctaatgcaggatagctggcacacttacaccttcctgtgactatgttgatggcctctactgatccatggcactgtttgtgttctaagtggctacacactaaagatattcccaactgggaagtctgccctgattaatgtccttcacacataaggtacagatggcatggcacttcttgccttaattaatttattagggacgccatatgggaaaaacagctttcctttcaactggaattacttggggaaataaaacgacaacccattgccgtgggactacattaaattatcaaactagctgaagataaaagaaatcaatgaattgcttggacagaagctgtgtgcactggcatctttccattactcctatttttgaaaaccagatagaatgcagtttttcaggtgatgcaacattttaaatgcagaactgtttattagagttgacatcaagtaaaaatattcaagactgagttaataagactgttcagctgaccattaggatgccattgtttaaaattttgtgtaataacaatgtgttggaatgacactggggcaaaagcgtgggtacacaattaagttttaaatctgtgcatttattaatgttttgctctaaatgttacattcgtgcactaggagaaatatacaatctgtgcaattgcttagggagcaaataatcaacatttcttatgtaggtgtaagtaactatgggtattagacttttcctcaaacctgtgtttttcaatctcgagtaattatacaaggaagatgctcaataagtatttgaagagttaaataatcttccaattagttttaaatttggtggcaaattttcattgccatttcatagttcactaaaggatcatggggttccttttaatgcactctacaagatattatctgactactgctctaagagagttagcagcttaacttgcatgttaatattcatagcaacaagtcctttacactatttttgttttacagtgaattaaaacatcagaaaatctaggccatttcctgaataagttatacaggcacaaagatatatatttgctggaaagcatttatatttatttttcttttctcttatacaaactatcaggtacaagagcattatatttagaggtgcagaatacacagtaaaatatcttaatttttaaaattgcattatctaactttctacactaatattaaaacgctaaaatctgttgtttgggtatctttttaggaagataaatctatgaggatgtctatgcaatgccaacaaatcatatttcactgcataactgaacatatggagattaggaacctcataaattgaattttaaatgaactgaccttattggatccttgacaaaaggaaaaaagaatgtaccaacaagaatggaaatatattaatggattagatttatcacgagtatcaaataaaataaaatatactctgttagataaaaaatatgataatatacagtaattcatattctactggttagtttaccattgacctcttccctctcatacttcccattataaaaatagtgtgcagttattcaagaggtgttgttcag

SEQ ID NO: 78 - DNA, 1962 bp, Artificial Sequence
  Description of Artificial Sequence: Synthetic polynucleotide
agggcctcagtttcccctgtctgtaaaatgggagcattggaccagagcattccgaggcccatgccagccctgagtgaccccctcccccaacttggctgtgagctcctgggggtgggggtggcgcctgcctgcccatctctgccctcggttggtgtccgcaggggaaagggaagaggctggactcggggagagacccctctccactcagccctggtgggtgcgggaaccaagggaagccagccctatcttcttgtctcaagaccaagaggacatgttttctccctggagctgagctgagctttctttccctatgtttatttgaaatttcatttttaaagacgagtcagggaaaaatgaggcttgcttctctccctgcccctccctgaagaattccagaagctgatttgtcttgtcaggatgtggcagggagccgtggcctgggctggctctctgagctgttgcatattgatcagcattgatgggtttggcacagtcgagttcttacagagctggcggaagtccctctggagaaagaactgcttcggggactggctttgatttgcaatgagtgtaatagattaaagcagtgggtcagcatgtcttattgagcaccagctgtgtacctcagccctggccctgctgggatccaagctcagatccccgcctcccccgaccctctcggttgccaccgagccccacctctgcctgcccgctgcacctgctccagtctccacctggcttctcctgctaggggctgtgccctgcccgctagctgcctgagcctgacattcagggccctccagtgcccaacctcaacccacagcccttcactggttcagttgtcatgcagtccgcagacaccaggaagcatcctctgcgtgcagccctggagatgtagaggtgacgaaggcagggcggcccagaagacctcacctcctgctccaccatcctgggcctgggcctagcggggtaggctggcagcaggcctgctgcctggactctgggttcgagctggctgggttttcctctgtgacctttcccagccttggtggccgctgtgcacactcttcagaatgacgtctgcagagctctcagcctggggcctgcccgttgctgggtggttgcaggaaggaggccacttgaccccgttccagccaatgatacctccctgaggacaagggtgaaatgtgccgggaggcccactgcctgccttcctgcttgcttgggcacatgtgaggatgtgatgcccggagcagcagcagctgtcatgtgaccaggaggagctgaggatgaggatgaaaaccatggaaggaaagagggtgtgtcccctgtgccattgttcttgagcctccaagaacccacccgggacctaccctttgtccagacttcctcctgccgaaggacgtactaagtggacttactgttttacccttttagggaggaaggttctgtaacttgcggctgaatgcgtccaagccatgagttgtcccccaagctcgtgagttgtccccagctcaattctgcctcctttggagagtgacgtcccacacacctgtgcaaccttgcatgccaaaaggactttgcagacatgactgaggaccttgcatgcgggaggtgatccccacgacacctgtggacccagtgtcatcagggtccttgtaagtgaaagaggcaagaggaccccagaagaggaggtgtgatgacagaagtggaggtcggagtgacatggagacgggacccctggctgcaggatgcagtgcttctgggagctggagaggccaagagacagactctggcctggagccttcggaaggcaccggccctgcagaccacttcagacttctgacctccagggccggaagaggaagcttggtgtggttctaagcggtggcatttgtgatcatttctcaccgcagccacagtagatggaggcaacacccgtgggtgtttgagggatggatg

SEQ ID NO: 79 - DNA, 1952 bp, Artificial Sequence
  Description of Artificial Sequence: Synthetic polynucleotide
gacagggtagaataaagtgacatttgggacaagaaggatgtggtgggtgaggatgagtcaggtgaagcaggatagagtaagagagtattcctgtcagagagaaaaggtataacgatgagaactgataaagcatagggaattacattgaatgaaagattagtatagctgggtggggaggtgtgaggtgtactattccatgatactgaaggagtcagcggtggtcagttttgcagggacttgtacccatgttaagtagtatagactccatactgtgagcaataggcaactcctgaaaggttagggaggacagaacggttacgggatttgcattttagaaagaccacctattgttttgtcaagactacactagcgagaggagacccgtttggaggctgtagcagtaaaactggaagatgatggaggtctgacactgggtaaaggccttggggatgcagagaggtggacaaagataggtagctttggcagtccctagtgatcaattagaagtaatggagatagtactcttgggttccatggatagtactcttcgcagagagtagttgccatctcttagagactatgtgcttaggttggagattgtcgtatgttccttaacccatataacgtaagataaaagtattagatggaaaaatatcagcaaagcaacaagtatatttaaaatgcatatatatcagtgatataattgggaaaaaatggaaatctagaagtaactgcccatcacctatttattcattcatttaataaatatgttgtatgtgctgtggacttaagggaagacagggttagtgtttttcctgttctcaaagacctcataagctaatgatacatcatagaagttcttcctaatgatttggaagactcttccagcagctttaaactcagaaggggatgctccttaagcacaactatcacactctgggagactaagtgctctctaagtagaattagaccaccacaggtcagtgtgggatgcagaagcagatcagcctaaagtgcaggccagtaccagaggaacaggacctttcaggactaagcaggaggactctgaaacacttcagactatgctgttaacctatgcccaatgtgcagtgattggaagttaacaccaaatctatagttgacacctgtacctagttcttcaacaaatagtattatttatttcagaactatgccaaagaaagtacattttcagacactattaagatttagtgtagtggttaagagcgtgactctggagcagactatggagcagactgccaggaccaaccacttactgtttgtgtaactttggcaagttttcctttgttcaaaatatgtttatttttctcatcttaaggctggaataacagtgtgtcttatggcataaagactgaatgggacaatatatgccctccaatagtactttgtccatggtgaacatttaaacaatagctgttattaacataacctgaattacaaggacctgacatttttactcattattctagagctcactcatcgcaaaaacaaatgtatttcttttataattactttagtaatgtgccttttttgttcccaaaaggtacaactttaataactcaatttatttaaaatttttatttaaatggaattaagtagtaattttcttgacatcaccttacacttttgaacatttttaacttccaaatagcttttagatcttcataacatttctataagcatcataggacagatatctcatttaataaattaggaaacggggtaatatagatttagcgatttgctcatagtagagttaaggcttataagctcttaatctagtatccatataaatcaaccaaaactcaaaaaattattgggcaactgttatgcacccagcattgtggtaggtgcttcggaggatagaaatgttataaaatactatccaaaaccaaaataaatttactttctat

SEQ ID NO: 80 - DNA, 1935 bp, Artificial Sequence
  Description of Artificial Sequence: Synthetic polynucleotide
aacaaacaacatgtggtatacccatacagtggaatattattcagccttaaaaaggaagacaattctgacacatgctacaacatggatgaactttgaatatgttatgctaacagaaataaaccatgaatagacacaaaaagtcacaaaatgataaatattgtatgattccacctctatgaggtacctagagtagtcagattcatagagaaaatagcagaatggcagctgccagggcctgaggaaggggaatagggacctaaggccacagtctgccgaccctggagtagacggagatgaagatgacaagacagaagccagggccctgaggatgggattgagaataagaactcagaaaccctttcatccagggagatggggagaggacgcaggagggaggaaggagctcctgagaggaggcctgcagccccgtaggcccaggagcagcacaccgctcacagccagaaaggagaggccaggaggcagggcagagccctggcagggcaggcgctcagggagagggtgggagccacagctctgggaggcagggccaaggtggccaagcagcactgagctctcgcccagggtggatcccccctgcaccctccccaagcttcacggcctgggtacaggaaggggtgacaagccatgcagcaggcatcatgggtcagtggacaggggacaggcagttccctccagcacggagggcacgacaaccactgcagggcaggcagagcccaccagcgcccaccaggctctagggcaaccaaactagatctgaagggaaactccacggcccttcttagaccaacccccttcaatatttcacgctgtttggtggctctgaagatgcatggaggttctagcggggaagagcccattttcacttcctccatactctgcacacagggcatccaggcccagaagagctcaacgctgcctggcatggagaggttggcgcaggctgaggctgctgggctctgaggactcagggtgtgcagcctggaacctgcacctcctaatgaaatatggcctaagcagacaccaggatccagggcccagccactcctctccccgatgctgaggccctcccgagagcccaagacacggcatggagctcgcgcgtgactgcgagcaaatgccctggcctcaggccgccaggtcaggtgcagcaggtctgtgagggaccccgtgtgcctcttctgtgggggcagcatcagcttccctcctagagaaccacatggagcagatatgggcggtgcagcagagcgctgcagcggggggccaggagggtccaagcagtgctgtgatcatccgactctctaaccatgaactcacctagagatgcattccaaccacacctctctaaaatacatgtaggtgttagtggaaaacacctgttatctgtttctgacttaataaagtctatttcatacacacagacacatttggtttacaggcagatgagacagtgatcgggcacgtcagcagacagtctccactcaggccctacaaatgaacaacaatcttcctttccgttttgctttcctctctaaagtcccccgagaggaggccctgcccaggccggcccccaactcacaggctccccagactgcagagatgcaaactcagccacacacccaaggacgccgcttctctccacagcagagcagaggctcagctggcccactccagtgacatggagtctggctggtcagcgacagcccctccagccaagggctccaccttcagcacaaatcctctgcctcgggactttctctagtgcttgatttcttgtatggtcagccccgcggtattttattgaaatagatattattcctgtcatcaaaataaataaacctaactaaaaagaatcctcttcacttatttgaagagtgccattttgggggactcttcaatatttttcttggcttttta

SEQ ID NO: 81 - DNA, 1930 bp, Artificial Sequence
  Description of Artificial Sequence: Synthetic polynucleotide
gcccacctgtgtgcttctgttccaggccctctactggtctatccgcagcgagaagctcgagtgggccgtgtgagtgagactccctttcccctctccctctcacccctctcccctgtctttgggctgtcctccctctgtcacccacccgagagttagagaaactcagatagtgctccccttggagtgaggcaaagccagaggcagggctctggggagagagcatagaggaacccaagtaataccggagggccagaggtagtggggcgtggggtatggcagaattttcaggaattgatgggttcactgtgaaggaggactccttgtggggggtcctggggtgtggcttcccaggaaaagagaggttgctaaggctctgggaggcaatggatacctcccagttctctttgcatagtcagcacttccagcccgattctctgatgttcagggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagagtgagtgtctgctgcccacaaacagggtggcgtgctgggagcagccctgctcagggacctgtgccgatgcatgcacaggtgtgcagagagacagcccgcattgaggacaggcagccagcccatgttccttcctcagtgcgtactgaacagtgaccatgtgctggatgctgtgtgaggcactagagggtaggtaggagaacccagacaaaacaggcctagttattcctgggccccagagtccctgtagtaaggtagagattagacaagtgtgtcaatgtctgcgaaaaaaatgtagcaagagctgagtgtctaggggctgaatcaagtgaggagaaaaaggtttttggttttgttttggaagcgggatgtggctacagggagaggtaaggcttctggtaagtgatggtatctgcgctgaactttggaggagaagagggtctggaatttggaagctgggcagagggcatcccccacagagaaaacagcaagccgagtttgctcagaacatggggtgtgtgaaagggaggtactcttgaggcaaaattgccagggcctgcatttgggccttattccacaggcagctgaaggcttttgattatggcaccaacatgtccagagtggtgatctcagcagactaatgtgcaagcacagattgaataggctggggcgaccaggatgggaactagcattggctgtgaagccgccggggccctagggctgccttttgtccaaggagcttagaatggatcttaccacacaagaccagggtggagaggtagggggaaaagagggcaggtggtgctcagagtggggtacacagggaagggcaccccaaagctgggctctgcgcccttgagcccctctagatgggtatgcaaggtcaagatcatcctgcagggactagaaagctgtctgggaggagctgtgtttgtgcctgggtgtttgccactacttggggtagtgggtgtgtgtttggagttggagagaagatgatatgtatgaatatctatatttggatgtgagtggttctatggttttgtttccagcgggcattgcctgtgtgtggagagactctatatgtttgtttacgattgtatgtgttttcttgtgttggcatgttctgcatttgtgtgcatcctggtgagagactggaggtggtgtgagggacagggggcatatgcacacttgcgtgtgtctgagtgtgtctggatgctggtgcccccacctacaacatttgtgttctgttcctggaacagcgccatggggcaagcgtggctggaagatgttccacaccttactgcgagggatggttctctacttcctg

SEQ ID NO: 82 - DNA, 1919 bp, Artificial Sequence
  Description of Artificial Sequence: Synthetic polynucleotide
ctgttggacctgggacccttccatgaaatttattttcaatcttgaatgagatttactttaatgggaggccttaaaagcagatgccatgcgagttaaaatcacacagcttattgcatctatcagttccagtcagagctgatggcaaactcttgttctttcagttcagtaaccagagagtggaatctgtctgtctgtgtcttccataaccaaaatacatcaccccacgcaatgcctcctaataactggggctttgtggtcagggtttttgcagggcaggccccttttctgcaggcaaagtgctaatggccagcgcctacactgcaggcctctggcgcattctctgccgagagttctgtccgtcccacttctcctcactgtctagtcttcttctgaccctcccagcctggttcacgtttgctcttcgttaccctcttcctgtttctttctcctgtctctcctcccaccacaccatccctcacatgcaccatggggtgctccttcagattgtcatctgatcgagccacagtcccactcagcccatgtttgtcaggactctgccactggtcacttgtccacaaggaaccactgtctttgagcttcttcctccggtgctcttagcatctgcccacactgtatctatctgtgtccaggtcttgttttctgtgtcattgtttgatgaaaggcagggactcattcggtgagtgggtctcccctgcctctgccccacaccagcacactgctctgcccttggtgggcacccgttggtgtgtgttgagctgggtgttgtacctcggtgtctgcgtggagaaatgcgaacagtgagtgccacagcacagccacgggatggttgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagtgaggccgacagtgagttgtaggaagctcagaaatgggatgcccgcactgccttcaattcaccctccattgtccatcgccgctggcatacccaggtcagcgcctgcaggcccctgtctcaaaagatgtggccggcttcttgtcccggtactgcctgaagcttcacctcagcaccgctagcttcacagtggccacacccacctccactcagcagtctccatgctgtagcccaaagcatgtagtggcggttgagtacctgagtgggggaaataattaactgggatgcttttattgataagtagtcagatgcctgttaagtgacatttatgaacactcacgtagcactgctgcctgttagccaggcactagtcaaaggacttttgatgtattagctcatttaatcttcacagaaactagaagttagacactatcctctccactcccttcacccccagccccaaacacacacaattttatagccgaagaaacggaggcacaaagaaggtgaagactttgctaaagtcacaaaactggtataagcatgggctttgtgtgtgtccaaagttcatccctcaaccgtttctctctggatcaataattaaaaggtttatcaagaagtctgaaggtaaatggttcagtattgtcaggttctggataagtttctctgtgttcttgacttttccctcatgatgacaagaaggctgccaccactccaaacatcacagcctcacagttgtgctcaaagggagaaagaagaagggacggccgttctcctttgagcacactgtttcactggcttcctgtgggttccactggcctgacttgatgcctgggacactttaagcatctccggtgctatgcgggctgggaagaagtgagctgtagaggcagccagtgttactctctgctcctgcgctctgtgtgcagc

SEQ ID NO: 83 - DNA, 1897 bp, Artificial Sequence
  Description of Artificial Sequence: Synthetic polynucleotide
ggtatttccttgcacttgtttatcctcctctccacaaatatgtggcagggtgtaaatgctcactatttcagtacaaaatcttaactgtttttgtttttcttccctttttttgatggacaagaaagtgaaatgcaaatattttccctcactttggattagtaatccctccctttcctggaggaaagaggaacatgtttttcaagttatgaatctgatgaattataaaagcatatggtgaaagaacaagagggagaaatatccacccaaactagagatgactttagaggtcctgaagagaagagatctgtaggtctagaagcaagaggacccattctctgcttgggtcattactatgggaagcaagactccaggcaggaggtactcagttcatctaggaaaacaaagccctaggcaatgggttgcagagctttgccgaatagtccagtgtcctaaatatgtcacggaaactgccagatgctgccagacctgccagtattgtgcagacacagacaatgggcatgtcagcattgactgatgtgggagatgaccagtgactaaggaaggcctccggagccttggcagagtaagggagtgtgactgaggtgggacccaaacctactggagtgatttacattcaccttcctaccagcctaatgcgtggcagcttggagtcaaaattaggtggattcataggtcataaacgttatacttctctcacacttgagctttccgacttaagagtcaaacattataatacaggagattcctaattcagggtgtagatctagtagttgagagactacccccggaggaaagatttctctgctcaccattccttggttacccttccagatttattttggccacactccaaccatgcttcagcctctcacaccacactgctcaccagcctcagccttgattgtcagccccagaagctgggccaggttttcagggttgggcttcagtatctcctctcttgccctgtcttgatctggttcatctcaagaacaagacacttgcaggatgcaaggagtttcacctcttcagtttcacctttcagaagctctggggtggctgtgtgcccccctgtgactctcaaatctgtatcttcagccctgccctcactacagaatagcaactcgtatgtatgagaattctactggacatccccttgagattcctacataaaaatcaagaatcagatactaaaaacgaacctattagctcatgctaccctgccctttgatgtcaccatctcagtgattagaaccacgacccagttgctttaatcaaaaacccaaagtcactaattcctttaaaatgttcttaattcactatcttctccagtcccattgctgctgagttaggtcagggcctcatcatctcctgtttgaattattacaacagcctccagtttgtccagtttctatatacactccacaaagccaaactgatgattctaaaacacaaagtgacggtcagtccccttttcacactcttcagagatgccctactactcttgttgtatgtcttacaaattatgacccctggccaaatccaacctgcagcctaatattgtacggccctcaagctaagaatggattttgtatttttttaatgcctgcaaccaaaacaaaacaggaacatccaatggtggccatatctggccttcaaagcctaaattatttactagctagtccttcacagaaaaagtttgctaccccactaaaatttagatagccccactctggccctcctataaccacttccccccctcactcaggacaggagtctgtatgggtccaaagggctgttcttcccagagcctgtgtcctccctacttacagacaacactcctggaacacccagcccaaagaatctgagtctgcttcca

SEQ ID NO: 84 - DNA, 1896 bp, Artificial Sequence
  Description of Artificial Sequence: Synthetic polynucleotide
aaccacctccattggctggagatatgttagatatggacataattccttggtcacagttataacacactaggacattatgtataaattcctacctagatcctgctctgcaatgctcagtctgacaaacataccctgggttttgacaattatattatgctttgaggtctctctgatttttggcaccactttgagctatgtcttcactcagtcaccttctattattagtccagcagctccaataatgatttttctcttctacggtgacccaacaatcctgcagccttgttccagactggcctgaataataagactgtgggtagtggggtatgaaagtttaagcagcactcagaattcttccactttgccagctttaaccctgcctttgacggatgaaccaaaattgaatattactggagctgtaggaagggcatagtgtctcattatttctcttcctccctccgcaagagagcacgtggttgaagggggggggctctctgttaagtaccagtaactttcaccttcttaagctttgatttaaagctagtttctagtcctgcaaacttaaaacaaagagcagaccaaccaaagaacaacctgatgataattagatggctctcaaaccattaagttgcctcttaaaattcttacctgtggtgagtacacaacattcaacaccttcactccacatgcagcctctcactaggcatttataaccaattaccttaggtacagatttattagagtggttgagttaatgtgcctcattaaaacctcatggagataagtaactcacagttccctgctggctagaacatcttttctggtcaggttttcactgccgacaggcaatggaaagttgattaaccagcaaatttgacaaggttagatataactcaaaagtttaaaaacttcacaggaactatgagactcatggtctgcctgtcattctgggaaatcagaccttttcccaagaaaaaggacatacagggaagtgtttgctagagaagggagtggtcaaggaaaaatgtcctgtggtattttttctgtaggtaacagtatggttctgggaactattcccaggcactctatttccatctccctgctgagcaatagttggaggtcacagggagatagaggaatggcccccagataagaaagcatgagtagctgatagggagggtgatatcaatgttttatcgtattttttcagagataatgaatctgaactttggagctacccagttctcagttatgcggagtggatgagcagaatgaagaagctaagaggtatccagggaaagatcacttcttagaacgcagtaaactccctaaactggtggtagaggagacaagctagattttaatgggaaaaaggaggctccttctatatgtcacttagtaggagatgggtcatggcaagccccactggttgacacaggtagtttctggcctgacacgtgctgaagtagcctccatcttcaagtagccagcacggtatcctgcaggatacagtccataaggtggatggttgtaacttgtgatggaagtagttccaagcaatcttttcaacaggtgtggaaattattaattatctactcagtgcatggtgaagagttaggtctagggagtctagagagagaagtgaggtgcccatactaggaagagttacaggaagtgacacagtctggctctgagaggttgttggaagaaataattattgagcacgtgaatatacacatatttcttaagcaatagttttctttcattaagcagttactttcagcatattacatacaacttcccattttatattcacagcgattttatgggacaagtattttccaattatacaaaggagttaggtacaaaaagactaaacatcttgctacccaaaaa

SEQ ID NO: 85 - DNA, 1896 bp, Artificial Sequence
  Description of Artificial Sequence: Synthetic polynucleotide
tgtcttggaccccttaagtaatctgagctacatgttgtcacagggaaacctgagattggtctggcctttctagggctgttgtaaaggttaaatgagatagcacacctgaagcatttgcctaataatgccaagtacatagtatgtgtgaaacaaatataatctattaccattataattgattatgaattgttaaaggtacatacctatattgtacctttaggttacacgtggaccaaggtaatagttgaattaatcagtctgtgaccagaatgggtaagaccaggtgaggaaatccatctgctcaccccaaaatgccaagccccaccagaggatggtggcttaagcagggttcattcctttccagatatgccccacctgaatttcacacatacctcatttcacctgaccctcatcacaattctttgaaacaagcattttttctcccagtttgcagatggggaaactgagactcagagtttaaaggatttgcccaaagtcatacggcccggaggtgagactcccagagcttgcaccttcttttcccagcttcaagcctaggactcttgccatggtagaccagctgccaaacaggccaccattttaccaccctgggacaaacctgtctttgagctgtgcatcaaagcagaggcatttctcaaaggcgggagtgcctcacccatggaggggacagcaggtgctcactgtgctcacaatggctcctttcatgccagcccctgccttcatgggccaggaggggtctgttttcacccctcaggccccccaccttcattcccctcctcactctttcaaacaagactctgctgcttggcacacaccatggcttaaaaacagggagcaggctcaggttgacaatgccaactgcacagtcaaccttcaaactccagcaggcatccgccctctgtggcagccagattcagagactccggccagatctggcagactggtagacagccatagaactgcaacctagggaggggcaaaccaaaccaagcagaggcctggggttgccatttgcaagataatagctaaagcagcttctgttaacctcacagttttagagcccagtgcctttctcttgtgccatcctcagtatacccagttcagagctaaactggaagcagatgaagttggttgcatttctttctgttccctcttggctaggatccagcaccctctagctccatgctgccccacaccccaccaagctgcatagacttctcagcccaggcactgctgcctgcccaatctttacacttcagtctcagtcttcacactttccccatccctgattggaactccactcagttatgacttccatgaataaacaccagaatccagatagcaaatagctggaaatcctactaatcccatgtccctgcctcttgttctatgcttcctgagctatatgtatgtaccctttgtaagtcaaggatcataattaggtcaaatagggatttagtcattaaacttaagagcatcaaaactgggtgtcttcataaaaagcaagacataaagaactacttttccatcaaataccaagcccacgtttttgtatacatcaaaaatacaagtagattcaagaaagttatataagtaaattcacagtgatagagctgtaataaatatcaaatttaaaatccattgagatggaaaattgaaactaatatttcttttgaagttaacagcgtggaaggctctatgctgtgtcacctcaggaacagaatcttggggtagaaaaagctgctgatttgacctaatatgcatgatttctttttgttttgttttgtttttgagatggagtctcactctgtcgcctaggctggagtgcagtgacatgatctcgggtcactgcaacctctgcctcccaggatcaag

SEQ ID NO: 86 - DNA, 1893 bp, Artificial Sequence
  Description of Artificial Sequence: Synthetic polynucleotide
agtcacaggtggcggaatgagcggcagctggaagttctcatactggaagatgctgttgaaagcaggagcactctgcgagccactgcatggcctatcgctctcgctgctgcgattctgggagagttccgtgaggagagccagctgcaaaggaaggacacacatcagctaaggtttgtggggagcagagggaagagaggctcctgaatccactgcttcagatacatgagagacagtgctgtgttgcaggagtagtaacatgcagggtttgaatcttaggtccatatatcacaaacgagcagtgtgactttgggcaagttcacttcattttttagggtctaaatttcctcattcaataatgagactggactggtttgctcccaagggcactcaaactgtgctctccctggcactggagagctctcccaccctgggctggccctgtgctgagggctcctccagctgctgtggatggccctgctgccacccttctctccctgtggacgcgccctgggctgaggagctctgttctcagctctgcttgctccaccctctccatcttggtgcactctcctcggggtgaatgactaattatgaccactggctctgacctctcttctgtaacctggaaggcctcaaacaggcacccagctgccaactcaaactcaggggttccagagtggaacccctggattctaccttctccttcaagtgagtcctccctgctcccagcttccttattcccaccaatgacactagcagtaccctcgttctgtcagtggctcaattctggaagacctgccaaggaggacagaagggtaggaggagatgctaatgtcggcctgttgggaagccagtgctctgccactcagggggaccatccctttcacctaaagaggctttctgcgaaagtagggagctggcagcctggctcttgaggtgcccttgatggtcagaggagagacgaattctacacccaaggtccttagacttcctgcctgattagggtctttgcctgttgcttcccagaacattgtgagttaacttccaccccacagagctaatgtgaaggagaactcagagcccaggtcaaaatggtccctaataacagtagttgggacctgtgggatgggccaccgtgtccactaccaacactctaagggaccctgcgtaggctcacatggaggctggtgaaagcctggtccatggggagtgtacagctgagacgagcgggccatcagactcctcagggcagccctgtctgtgtctaccaaacactccaggagtccgaggggatgtctaacaacctctggtgactgtatcaagtgtctttccatgacaggcactttgctagatccttgacatgtgtgttatttctcatccttcacaacacagtgacttgccctcggtcaccagcagtgagtggcggtgtgggattcacccgccaggcaccatgtcttcgaggtgccctccgacctctggcaaagggtttttccctcacacaggcaatggtggcacaagctcacatgtgtccacgtgtcacttctgtggaaaactcagtaccagtggctgtggtaactgggaagacatctgaaggcccctaagttctaagtgtcaatttatcaaaagtggtccaggtcctggcccagagacacatgtatggtctcattcacaactcagtaactctgactcaagcactactccaggggccaagagtccactttgtgccacttccttcttctgtaaccctctcagttgcccatcagcctgcgacgttctctgcaatgactgttatgtatgatgccttgaatagaatgagccacagacgctcaactcaatgctttcacatcctgacactgtgaggtgggaagatcaattgcaaaaaaaaaaaaaaaa

SEQ ID NO: 87 - DNA, 1890 bp, Artificial Sequence
  Description of Artificial Sequence: Synthetic polynucleotide
gagacagggtttcaccacgttggccaggatggtctcgatctcttgaccttgtgatccacctaccccagcctcccaaagtgctgggattacaggcgtgagccaccgtgcctggccctggtttcctttttcttagcaatcttttcttcaatatactttttccaactctcacattttactatgagcagcaagaagaaaccaggctcttccttcaacattttccttagagatctcctcagctaaatatccaagtttgtcccctacaggttatactttcgacacaacaagacacaattgcaccaacttctctaccatgttgtggcaaagatcatctcctgcgttttccaatagcatgttcctatttccgtctgagccctccccagaatcacctttaacatccatatgtctaccaactgtatcttcagaacaattgagtcttcttctgacataaatgttaaaactctctctgcctctaaccgttacccagttccaaagccaccccggcattgtcaggtattggtcacagcacttcctttctcagaaccaaaatctctcttagcctgctcaggcttccagagcacaggaacacacaccaggggacttaaagccaaagaaacccactgtcgtagagttgtgaggtctagaagtccaaaatcagagtgttgtcagggccaacctacacctcgtgctgtaaagggggccctcccttgcctcttcctcctcctggtcaccccaggcattactcaccctgttgacgggtcctaatctctgcctctgacttcacgtggattcttcctgtgtgtgcatctgtctccaaatgtccccatttcataagggcacttctttaggcatttcattaaggctcaccctagtgatttcactttgaattgtttgcttaagatcacattttgaggtagtgggggttaggctttctacatatctgttttagataaaaattccaaattcagacaaaattcaacctatgacaaagtcatgctattgctattacatactcgacctataacgaagttacactattaactcactactacatactcagtataacaaactcactctaatactcactactacatactcagtataacaaagtcatggtaatactcactactacatacttggtataacaaagtcacgctaatactaactactacatactcggtacaaagtcatgctaatactcactactacatacttgacctatgacaaagtcacactattaccactgcccaaccaacctataatgcagtcacactattactcactgctacacactcgacctataagaaagtcatggtattaccgctgcatatccgacctacgacaaagtcaccctattactcactgctgcatactcaatcccagatttacaatcggaagcctctgctggtgaaaatatggaagtcaatactgaatgtccctttctttgccataaaactgccatcacacagaagagagaacttaccaagcaataccaacacattcattctccaataaaattattaatttcttcattttgtatacattcttcctgtcttttttaagttccattccatatatattttattctcaataaaagttttatttttaatttttttcaaactatctcagcaccatttgaagttttatactttcacatcagaaaaagtccttaaatgcttaaagtcagaatcatattaggtgacaacctaacctaacagcataattggaactaagtcaaatatcatgatgctctaaacgtcatcaacctatcaacactccatgctccttttgagtagttcataccctgcaaggatctggtgggatgttttctcaaggaaggaaatgtatctgtcagttacagattctcattcgatgcaataaccttctttctca

SEQ ID NO: 88 - DNA, 1887 bp, Artificial Sequence
  Description of Artificial Sequence: Synthetic polynucleotide
ccccagaccaattaaattggaaactctgggaatgagaccaaggcatctgtattttttaagcactgaggtgattctaagatgtagtcagcgtaaaacccactgctttaaactcaactatgtctaagccatgtccagccttctccctgtccccaaacaacgtgtaagaaatatgggtgcaaaatagtttcttcttgaaactgaaatttataaaatcttcaggtcctgagaccaagacttgtcttctaaaccaaggtgtgtagctgaaacctcaaaaaaatgtacccaactattttaactgttggagttaaatttctggagtacccaactattttaactatctggtctttgaaacatttgattatgaagactggaggctaacagggaacagtgaaaaatgtaccagagctgaatgacaggtaagctaggtctggcaatgtctgtttctgacactagtgtcaatggagaaaagtctgtttgaattttggaacttcatttttgtcatctgtaaatgaaatgtggaggttgaaagtctttcaaatggaaaatatcaggttgatcaaagatgtaggaagtgctactccctgttaagcaccacccatctaagtatagccatgcgccctcaagaaataaacataaaaatagtaaataaataaaacttgcccttcccagaattgccaaatatttggagagaaaagctgaaggaggtttggatcaaatcatccagatacaggaacttcatcttgacactggacaatagaacaatagagcaatcactctctttgtcatttcagccatgataagggcaggaatctttctgtctaggtagggaacacaaatccctctgagccccctctccttcctctgctataaaggatcgggctcacccatgagttgactgaagacctctagtttctacatgaccatcttcatgacctgttgctataactgttagttctgaatcattcagatcagcttgggcacgacctatacttaagcagttagttttctccttttctgaatgacaaatagatggtgttacagttgaaaatatcctgctctcctgcctgactcactgtcaaacaccgtgctggattcttctctctaccttgaacttggcacacaattgtttctatagttaaataatctcctaaatctctttaacctatatctcccttttcatctccattgccgctgccctggttcaggtcctccattcttggggaactttcttccctggacaattgcagcagcctcctgatgggtggatcacccattcccacccgcagtgctttgtgaatcactgacacatatgaagcatcatgcttggtgctcaagataaatcaccctggtcttgccttccaggagttcccaatctagcagatgagacacagacaaggaaatcactgccacgatttggtaaatttttagctgtggtatcaaaaatgtggctatttctggctatcaaaatcagagaaggcttcagagcagagggagtgtttgagctgaggggcattccaaaaagaaggcacagcatgtacaaaggcctgaagttagaaaggatgagaagtcattatcagattgcaagtagctcaatccagtgggcaggcagaggacaacctgttatgaccaggggctaataaaggaggcagaaggcatatccttaagaacaactacagatccacattgcagtgagaaatttggattttgtcccagggtccgtgaggcgccattggaggatcttaagccaccagggtccatgaggtgccactggaggatcttaagctggggagtcacgtgattatataatactttagttttagaattctgtcttgttagaagatgggaagatgccttgaaagagataaagcatgggagcaggtgatgctg

SEQ ID NO: 89 - DNA, 1882 bp, Artificial Sequence
  Description of Artificial Sequence: Synthetic polynucleotide
gggatacatgtgtggaatgtgcaggtttgttacataggtatacatgtgccatggtggttcgctgcacctatcaacccatcatctatgttttaagcccctcatgcattaggtatttgtcttaatgctctccctcccctttcctcccaccctctacctctaaacttttatagctgcacatttatcttcatttataccactcctatactaatttaggactggtcttctagtcactctgaattcttatacatctgatctaatctacttatttatcacttttattcttaaggcctggctgtaattgtaacttgctcccttcaaaaactttcaatgactttaaattacctagaaaataaagttgaatagtcttaatccagcttttttaggccttttgagttttaggtgaactccctttttaaaggccaaagggtctgtttggtctcaatctgcccttaacctgcagtgtcatcttggatcagtctgtacgcttggcagtgacaatgactactctcatggtttattataaggattatttattttaattcctagaagtcctggctttgaaagcttcattatctagcagaatagactttggaaaattgatttacttctctgggatttcttctatttgtttgtaaattgatgtggttcacaaatttgagtttgtataagaatcagctagagaacttgtgaaacatgaggactttagacctcatcccagacagagattctgacgatattttactttttttaaaaaatgaggcataacatataagtgcataaagtatactaatgttaggtgtatatcttgattttttacttatgtatatgcttgtgtgaacatcattcaggtcaagacacgttagatagtccccgacttaggatggtttgacttaacgattttttgacttaatgatggtttgaatgtggaacacttattgcaatatgtgatgaattattcaataaattgcatgaacttttcaacacttgattataaaacaggctttgtgttagctaatttttgtccaattgtaggctaatttaaatgttctgagcttactgaaagcagactagactaacctatggtgtttgagaggttaggtatattacatgcattttcaacttactatgagtttatcaggacttaggcccatcttaagtcgagaagcattgtgtgaaatatttccaacaccccgggagttctccatgccttcccagtctgtgccttttccagagatataatagtttctaaccactattttaacttctatcatgattcctttttagctatatgaattagatgaattttggtgttccttttaattctagttttctttgagtctcaatttctaattcagatggagaaataaaactattttgagtaagttcacattgtcatccaaaatttagatattttctgccatcaacatctaccccaactttaacccctcctttggttcttcacctccgcaagtcttcatattctttcttattcttaagctctattgtggctacttcccaagctaggatagaaataaagaatactaaagttacaagtcaagtattctaaccccccttacttgcaacaattccttctacaacatccctggaaagtggtcttttacctctgcttaaaaacttctggtaactgagacctgcttatgtcaaattattggacatttgtctttgctagaaattgctttcatatgttgatcattgtaaaatattatttggtatctttgctcatagttatgccctccagaataaaaagaatatccagtcttttcttctttatggcaacctttcaaatatttaagacagttgccacatatactctaagactttttttttctctagttattggagtcagaactcccagcacttt

SEQ ID NO: 90 - DNA, 1876 bp, Artificial Sequence
  Description of Artificial Sequence: Synthetic polynucleotide
cactaacaaagatagaaaacacgtggtgcaacttttgaactcaagacttgttcttccttttcaagatttgttctcaagaattattaatgtagaaaaactaaacaacttgtcctgggtccatgttccccaggccatggctatattccccacccattaaagggagaagcagatcccatttgggcaatgaacttaaaggccttggcacttcttgtgtgtagtttcattaaacattgcagcagcagtacctaggggagcagtgtttttgcctctttggacccaataatgtgtaaattctgtcacagagaaccgtgcactgagtctaaacactcatattttgaaaatacatttttacgttcaccaagttctctatcatttctaaatttttatagcattactatcttctcatatttgtcttctatcttctaggctactatttacatttacccctaccctggattttagacaataaataaacattggaggcatgtgctgaaagtaagattttaccaggcaaacaaggagaagagttttcatggtcaattgttttttgatgtttgttttgtgctgaatcaaagaagcaagaaagagcttggtgtgtccggggatcgtaggtggtttgaagtgactagggcgtgattctcaagtgcttttcttcatagcaccccagaagtgtgggtggcactctttaagggataaaaagatataaggtgacattaaacaaatcagcaataatcataacccaactggtactccttcatagaatatttcccagcatatataaaagtgcccacagttatctcaccacacaagtagttactcttcagcaatgtggttgtagtggagtagtatagtttactcccctgatgaggtatactcatgagccttgtaaatctcactttagagtacactttgtttagcctcttactggacaccccatatcctctcagctgaacattccatctgacaggccatggcaaaaaacagtgcacattctattgtaacaaaaattaagtgtgcacatttgtcaaaatggggtggcatatcttgcagatgcttggcaggatgcctgtggggaatcactaggctccaggagaggattgtatgggggaatagagtagatgtgggaggaaaagcaacagcagcaataaagatgacatccagggtgtattgagaggctaatattgataaatcttcatttacagtgtttctaatcctcacaactacaacaagcaaacttgttgttattagtttctttttcggaggaggaaaacacggctacaaaggttaagtaacttgtatgcatctattcaagtaataagaaacagaacaggaatcaaactcagatttatctaattccagaatccaggcttttccccatgatatctctaaaattaggtgatactagatcaaaagtatcctcatatgctatcacactgggatgtttaaatactacaatcaaaatttcctataagtgtgtcctgtgtgggatagtaattcttcaggatgggaaatgttgttactctaaattaagggctctggagcccaggtaggcttataaaatgctggacttcactagccatgcacacgctcagggtgcccatctcttgaacaatagtttgtatttatgaaaccactgtttggtgttggggtgtattctggtgccacgaaatagagcttctgtaagtgtgatgctaagctcacccattcagagattggactcatgaccttaatctcattagcaacgccattctagacccatactatagcttcttaaccaatcacagtgatacagctatacttcgaggatacatagcaaattccttcagttgcatgttttgttctgctttgcttttttaaaaatctctttttaaaccaa

SEQ ID NO: 91 - DNA, 1872 bp, Artificial Sequence
  Description of Artificial Sequence: Synthetic polynucleotide
ggagggggttgaaagaacttccttcctgatcaaccagagttggcaccatgcatgttatggaaaagcctgtccacagaaagaatggagccgcgttgcagagtcgggtagaagtggagagccggcagtccattgcgggaggcagggagcggtgtttgcccttgaccctctggtgcccttgccttcttggtgccctgtggttggcagtgtaagcttgcctctgcatttgctcggtataccctctcacaagttgggaagctgtggcagctggggctgaaagaagcgtaaccccacagggcctggcaggacagcagaatgcagaagagcggcaggtgccaagtaggtctgagagggccatagacagccccagaggaggtcctgcctgtgcagtggtgtggcagaccctatacattttcatgggcctggagtggggagctgaggttgactgcaggaacaggcctgtgagagaaccgggggtcttggatctggaaatgtcccagagacacttgcctgggagccgggatgggggttcagctctatccaagactttagtgaatggtctagttgggacccacagacagtggcaaggcagtgctccccatgtcctaagccgaggctggatgggacattgcacgtcttggctctgtacaggccacgtgaccactgagaagtggaaactcccactcagggcatttgcctagcacccgctcctcctcctccacaattatctctgtcccaggaggtagaggattggggggggggggcggtcttcggaatcgatggtgtttaagcccacagtggctaagaaatccctgcatttgactcggtttacttataagtattaggattcttctttggtgtcaaacagaagaggggctgagcatcagaaattaaatcaagtgacacccaaaacagagatttgcttttgcatatttgaatctgtaggcatgaagtgtagcccctgggacctgcatttcacagcaccccccatctcctcccccccaggaagatggggagggtcctcagaccacactcgtgaaccgtacttagcaggagaacaccgcacagaggcatggggctcttctgagagctgaagcggcggcatgtggcaaaggaaataggtgttgcctcttcagaggatccaggtgtcagcagttacaggagccatcttcagctccgctgaaagaggggcttcctgaccactgcgttctccatcactggatggatgtcctgccccaggatggagggccatgtgtcaggggttgcaaagaagaaggatgccctgttagagttagaggttgagcaaagaggcttctcatatcctcttctaacttagagatcaacagctacttacactgagctcctgtttgtgcatctctagaatgaataagaatgaataaatctaagaccctgggggctcccagttacagatatgaaaaagttaaagtgacccccagccctgagcccctgcaggaggtggggattaataatccctaattagcccatgcaattaccacaacagtccagattttgaaactattatcctgattttacagatgatgaaacagattcaatgacagtaattaacctgcccaaggttatgcagttaataagcagcagaatcaaaattaagtcccgtctctcacgcccttcccaaacattccagtcctctttaaataatctttattctaagagggaaattttcagaaaattgaacttttacaatctttccatcacactctgtggacgtcaaagggatttccatgtcaaaatcagctccgataaagcttcaactggtcacgtgcaaaagttcaattgtttctgcgtatttttttccacatctggaattcagctctctttgcctttcctccccag

SEQ ID NO: 92 - DNA, 1871 bp, Artificial Sequence
  Description of Artificial Sequence: Synthetic polynucleotide
gctgcacacagagcgcatcagccactgtcagctgctcattttcccaaagcccacaagcctcagccacgctttgcttctgcaagacgcttcttcaccttttcaataaacctgcctgaatttaaactgacgggggtttaattctccttcatcataaatgaaattcttcaccgcaataatctccaatgaattttgggcacagcaggcaggcccatttctgcttctgttccactatctcccctgtaggttgaaaaggaggaagtactgaattacctccaaatgttcctctggctctgatattctgttattctggttccttttcagctactttgtttttggtagcatgtatcctaaggcatccagttgaacaacctttgtctactgtgtccaggcattcctcgtggtatttcagataagacactcttgggttgctgaactcacaaccactgaaccaattctatgaccatctgtttcatggccacatgtttgctcattttatatgtatataaagggaggggacagacagcaaacttgcgtgttacaaattgtatcatcttaaaaaggaaacaaggcaacactttgcaataaaaccttaagatgcatgaaatttaagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaacaagtaaatcttaccaagatctgactttctgcagatataatattattttgtttgaccatccttatcttcaagggctaccaagaaggaaccaagaatttatttacctccccaagggaaaaggttttaccaatgagacactttctcaccatgaccccaggaccccatatgccctgttcacttgagtgccctgtgtggcctgacagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaaactttctcaccttcgtacactaatggttggaaggtacaacagcatatgcactttgggaaaaaatatctggcatattcttacagaaacaaacaactacctattctatgactcagtaattcctaagcatttatccaagagaaactaaaacgtatgtccagaaaatcacttatacaagaatgttcatagcagttttattcataatacaaaaaactgaaaacattcaagtatctgtcaatacaagaatggatcaataaactgtgatacactcattccatggaatggctaaaggaacaaactggtgacacacagaacaacaaggatgaatctcaaaaacatttggagtgcgatagaagccatacccaaaaaagtgcgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgggcgctctgtgtgcagc

SEQ ID NO: 93 - DNA, 1864 bp, Artificial Sequence
  Description of Artificial Sequence: Synthetic polynucleotide
tatgtggaaatcattactcaagacaattaggatggctaagcctgttttgacagcatacttggaaagagaaggatggtgtcagacaaagatcagaaaaccagactcctaaattaaagaaaaagaagaagtaaagagaaagttgaccatgaatcagttcaatgatagattgatggatttgaaataggcctttgaaagaaaacatcagatgtgtactatcaaactgtgtaactgtttaggatagaacttttcactgtgctaaattagatcagcgcataattttcagttaatttttgactgatggaaatatcactttgatgtgttctgctgtatctgacttctcctcacgtttggatttctgctactgaaagtgcactccagggaccagagctataaccaagtgccaagccccattccaataacaaaattaaccattatggctctttaggaatctccaagatagtcttcaattttaaattatctcctttcctttctgtgcccctacacatggtgaggccagtatttatgcctggctttcccagataattgctgggtggctactagccctagttgagacaatggtttagaaaaagcctcttactgatttcagaaagtctacatataccacagaagaaatactacttgctgtggcccctacctccaggacttcacggaccagttagctacagattaaaaaactttgtctagggagacagacttaatgctgatccaattttcttcaagagggaaagtccgagtccaaatatctgttgtatctgttgtggttaccaccttttgagtgcccttcctccaaggtcagtctccctccattgcattgtccccagttatgatgaaagtttctccacaggttaaaaattaccactcaatctacagcctttgggacatagaggaaacttctgtggcttgttaaatcactgtatttcggtatttcacacagtatatgctactgacatttaatcagaagaaacaacttttttctaaaactaaattgttaataaggagattacaactatttgacaagaataaaacatagtctaaagtttggaaaaagtgctaggggaaaatggagtaaactttgatgtagtcatgaggccctttatactcttgttgattaaaatttgcctgataaattgctttctggaaataaaatttaattcctccatgccactcacactccccagtgtcagggcattcaataataaatgggatctggataaaatgcattctttaaatgtaattattactttaaatatcatataatgattatctcttctttaaaagacgcttttactttaagacatgcataccaaaattttatagattaaataatatgtcttggatttgcttcaaaataatgcttgtgttagtaggagggaatatgtggaagtatagcaaaaagattgagtgggagataatgtttgaatctgggtgatggctacttgcgtgtgtattataccactcactctacttttgaatatgtttgaaattttccatcataaaaagctcaaaaataatataatggtcacccttagagtcagtcagttctcatcaacattattacttttctcaaaggcaaatcatttagaactacaaagcaactgtacattatactcactactcacctctgaccccctaggtcttcattgggcaagcaatgttggcaaaaagttttaactttccagggaaaagcttcagggaattcagcttgacagggtgagtgtagaagaatttatactaaacttttatgtgtttctgcagaatcccttcctgctggatcaagagacctatatgttcatatgccagaaaaaaggtgaggctctaaaaagagaggagagattatggacag

SEQ ID NO: 94 - DNA, 1864 bp, Artificial Sequence
  Description of Artificial Sequence: Synthetic polynucleotide
gggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcacgcgcgtgggcttttgctaccagatccggtgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagccgcagtgagtccctggtgctcccggccccgccagggccctaaccctggggcggcatgctttgatgtctgggaccagagcttggaaatggttgagactaccctgccacgatttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccccagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgtcgttccaagctgcgcgtggctgggggccatccgggcaactcaccctggacagtcagcttgcggaatcggtgaggcacaacggcctgtctcccacagagaggagctgaggttgtgtcctctgtggttatgccactgggggctgggaatctatccctgcccccagaggtcctagccagaagatggcaggtctagcatctctcccaggagtctgttccctgtcctaattccccactcctctaggcagggccagcatttctgcggggggtctctagtgaaggagcagtggatactgactgccggcagtgcttctcctcctggtgagcctcccttgtgtttggggacccagtctcatcccaccttcccctttccccaggcaagctaacaagtgagccttggggcaacggactgagagtcacaaatgacctagcagagcttctcacccagccatatgcctctcacgggctatgaggtatggttgggcacccagaacccacaacatggagagccaggcttacagcgggtcccagtagccaagatgctgtgtgggccctcaggctcccagcttgtcctgctcaagctggagaggtatgtggacaacctgggaggatgtgaggtggggctgagccttgtggcctcagacc

SEQ ID NO: 95 - DNA, 1838 bp, Artificial Sequence
  Description of Artificial Sequence: Synthetic polynucleotide
aggatgaactcagaaaacctgcacaacaaaaaagcctctcaagcttagcctccttttctttcttctttggggttattctctcagccatcacccatagcgggaacttagccattaactctagggccatatttatatagtgctgggaacataaaggaaaaaaaaaaaagaggcttccctgttagcttcagccagaacaatcctgggctgggagtctgcttggactggctttgcccttggcctcatcgcggtggccagagagtggaggtgttgtgttcatctcagactgagcctgagcagtgtgattattcatttacaggaggaaagggaggcgtgttgagcaggcaaaagggttttaaagcccctggagacattccaaatataccaaatgataacttgatttttggcaatatgcttctgtcacaatgttaaatattcatctcactcccaagtgccccgtgtctttcataatctaaatctacgattggtacctcaattattattttttgttcttaattacaatcaatattacttgaggcttcctcatgattgctttatttcttttttatttgttcaacctcagtacagtttaatatttattgcagatattgggactggctcactcagcatctcttccaaacgcttttcagaatttctcacaccactgcagagtcaggaaagcaaacactttattttccagactccttgctcctagattctagatgtgctttaggctctgccaaacagtagcactggtgggagacttgaatttggaattgagttcggtagggagacaggcagctcttgggctattcattttgtggggaaagattgtggcacacatggtatggttctggagccagcaattgtggcagaggctgcccaatttagcagatggctcctggatcatggcaagagaagcagtttcactggtggccaagttctacattgtggttttgcgatttgtttctggaagctcagtctagtgtattttttaagccttcccaatgattatgtaagtcatgtaatagcctgcaataaatccttttctgattaaatagcttagtgattctgtgctctgccattgaaccctgacacaacatagaaattagtttttaaaatgtcattgatctttttgattgtgttatttttctttttcttatttgtaattgcatggatacaaaacatgaaatgaggttggcattatttattgctttgatgagcaggtgaattagatgatcacagttgctaactgatgcttggttagttagacccataggaaacacctgctgtggttcaacaagctgaggctggaggtcttccattggcccctataggtccactcctcacccttctctatcctgctctgtgccctgggactgcctagcaggaatggctttctgtgttccctggctttgcccatggggagacttgatttatgctggttgcccgtccctccaaccccaagtctttaggttaccatttactttctctttcaaaagtgtcctagttgatgtaatcctcctttctgcttagagtttgtactctctaaacaatgaacacttattaattccttactatacagttcctctgttttgccaactgagaatgtatagtccaaaactcatgagcagaatggccactctggtgctgtagcagtctgcttttgcccctggagtttggtgaggtccggggtcttatctcacaactgcaaaataggcacacagacatggagggtgagtagggcagagtaaaatttattaagcaaaaggaaagctctcagcgaagagaggggtcctgaaagcaggttgccagtaaggtgtctgtgttctgtgtctttt

SEQ ID NO: 96 - DNA, 1838 bp, Artificial Sequence
  Description of Artificial Sequence: Synthetic polynucleotide
aaacagcctcactgggtcaatggatatcatgtggctgcctaacatttttactttataaaaggtcttcctgaggccatttgaaagtatggatcaaaacactttatgaacagggccacaggtttgcatgaggcttgtcagtggacctccaggatgaagaccaaagtgactgtgcaatttctagtggaataatttacacttaagatcttatttatttatcaaaagactgctgtgaggtaggaattcttaacccccatttgcagaaacagactttgcctgacaccacagagctaggaaaaagtgggcataagatcctcatcaagtctgacttccaaaagaagattcaaaaagaaacctccttgctacccgccaaatctctgtagagccagccatgttcacacatgaaacaggacaatgacaatagcaccaggaatagctactcctggtcagatgccctcatgaggtcaactccgcgggatggggacaccgggccctgcttaggggaaaggaagggggtttgtagaggaagcccagccagccaagcaaccagagatgggaaaaacctattgggaagaacttgcttgctctagctgggctttgcaaagaacaggaaaagatgagtctgcacagacagaaatggtctagaatggctgaatgtttcatgtagaaattttattttatgattaatacactcgtgccatttcttggaaccacttgcttgtttaattctagtctatcaagtgataattttgttgatatttagaggctcctcagttaatttctgtgggatttttcgttatatttaataaggaaaataataggaaatagctaagaaaaaaagaaacaaagccaattattcctgagcgtgtttaaaattattgaagtacacttgttaatttttagtatagaacctacatttcataatagaaaaccttggacttgccagtgttagctgctggaataaggtgtttgtccagtacattcagaatgtcgccacagattaactttagctcagtctcaacctgaaaaaataaaaatgaattttaaaaaattcagattgttgaagtctagaaattctgtaagttattacacattctatgtacctctgattttgaggaagagagcttagtattgaacagaattagtttccctctccaaactccattcctcccttttgacacaaaagcagagaaaagctgcctctgggtcatcaaaagtatcttttcctttccgcgtgcaattaagtgctacacacacacaccacccccaccccaacaccccatcacagtccaactgcagaatcaccaatgactgaaactgaacactgatgctacttggtaaacactggtcaattacatgaatctttcacaaggtagcaactattgtgtccatttacttgggaaaacagaagctaagacatttgctcaaagatcatccccttaaaagaacttaataagcagagctaggatttgaagccaggcagggtgcaagggacagaacaaaattcaaacccaggcagtttgccttcagtacttacattcctaacaacgttcaacaggcagtccctttagtggaagagatccaaaactagttaagataccaaaaatctatgtaccaagtaactattgccactcatctctattcatttataatgctgaaaacgtacaacacctctaaaggcagatacccagtttacttcctttttttttttttttttttttttatattgagtcaccctctgtcaccccggcattatttcagtggcgtgatcaaggcacaaatcaaacaaccccaccccggcacacaccaatcaccggccccacccacccgtgtatcaggga

SEQ ID NO: 97 - DNA, 1833 bp, Artificial Sequence
  Description of Artificial Sequence: Synthetic polynucleotide
tgatagtgacaatagatagatggcttttctttcatttcaactcgaatggttgtaattttaagccaaagttacaaaaaattggtgtaaatatcactaacagagagatagtaagaaaataaagagctacaaatgtattcatttacgatgtctcagatatttttgattccaggtttaaaattatgtgtcatctaacgtcatcttcagtttactcctctgtaaaatggcaagagcatttaatttttagggtttgaggtttagatgaaataacttattaaacatctaccatatcccctgtttttccctccgccaagaaatatagtatattcactatatatatatcatataaagtaaaatactggctatgaaacatgcccagttttattacttttgaacctcagtattgttatacacctaacactgatggctgagctaagcaactaagaggtactattgattgataatctcaagctataatttttcaatgaaaaaggtttttcctctttctcctttggagaaaaaatatagaagataggaggctgagctaaaattttcatttatgaaatactatatttgccaactcctctgcttttaaatgtctggattgtacaggtggtttggggacttcatttattttgattagtttagctttatcctgaaatggttattggtccatgtctatgataaggtaaaagaaaattagaatcctaagaaagaaaataacaaaccactgattccattccaattatctttgtggcttgtgttagcattgattgtttcttgccatgatatttaagttcctgggactccactgcaaccactaaataaagagtgaacggaattaggataatctgattctggaagccagatactttgattgatggcttgtcatactattataaataagcaatttgccaaactcttctagttacagattagaaatatacaatgatcaaaaagagaatagaaatggggctggtacatgtggataaaataaaactagcagagtgtgaatcatttaacattatttctgaaattatttataattatacaattcagtatgctaacaatttagaaataagcttttaaaaatatttactataactacaaaaagaaatcttgggcatagactctgttttcagcaggctattattttctgctttctaaatctgttttgtttcaatttgttttactttatgttggtagcttgttgattctccctccagcccccaaatccaagagcaatgtttttttcattcatttaaacaccattgtgtttaaactcatttaattatcttattccctctagaaatagttactatcattagtaactactgatagataagttgttagatagatagttgatatataagttagatagatagatgttagatagatagttagatagagagttgatagataagtaactgagaaagtaactcctccaaagtctcagtaaaaggaaaaaagccacttcaagcatctgtctgcccaccttctgcccaaacacgtttttcaccatgctaaatatcaagttaaggaggtgccataacttgcattttgtgaatatcacacaattctttttgaattctcaatgatgtttatgtttgacttctattcatttcgacttaataaaatattcaaggggttgggttagaattttagcaataccaatatcagctatttattttttttaagtaactgctctattctgttaattaaggttaatataaggtcacttagtgataaggtaaaaagtgagagtgcctggctctgtacttggaacatagtatgcactctattttattcctgttttcctaagatacagtgaataaa

SEQ ID NO: 98 - DNA, 1832 bp, Artificial Sequence
  Description of Artificial Sequence: Synthetic polynucleotide
ggagaaatgcctaatgtagatgacgggttgatgggtgcagcaaaccaccatggcacgtgtataactatgtaacaaacctataatgaaatgtcaactataatcccagctcaaagagaacaccataaaattatgaaaggctttccacaaatctccaaatttatgtcttcataagattacatctctatttcttcttgaataatttacttattttagctatgatttagtgatagtaagatggtaattatgaggagaaaattctcccaacattccattgagaaaattctgcctcatttcaccacaaacctgagtcttaagcagtcacttctaatgtagctgaataataatagatcctcacccagctgagtctatgagttgaatccatgtatgtgagataaggcccccaaggagtggtaataagctgggaatgccatcagctcatcttccttcaggcctatatttgttattgtcacttgtagaagcaggacggcccctggcattgggattggtagaaacagagtatcaaagggaaaactgaacttccctaatttttggaaaacagtagattggaaacagatgggctccaacgttttccatgtgtgaggtcattgtcccaggtaggcttactcaggacatttcttgtctgcaaaacagaagtcaaacaatatttctaccttccaagagaatagaacataatgtcagattttcttatggattcccacaagttcaagaaagtttcatggccttatttaactgcttaagcatttcaactaaaaaaaaattgtctttcaaatacacagcaatctgtttggaaaaattttaacgagaaaaatttggaattctaaagtaaaaaatgcataaggccataaaaattttttatatcttttaatttagaggtcaactgggggaaaaaaaattctctgaagtttgcttttataccattaaagacttattttttattaccagcaatacagagggacttattcaggttgaatcttgaaggtaaactttaacttagttttaagttttggctaatttttaagcatttctcagtcacctaccatgatttcatctcagaaaccaaaatctcaatttcatttagacctttgaaatattaaaacagaaggctaaatgcttcaaaataatattcatgtagacacttacatatgtggaccaggaacctccatatatttcaaagtttatgagaacataacaaatgttgatacacacatttaattctgaaataaaggcttacaacaaataaagctgtaacaaatcaagaaaattttgtaggttacacattttatgtctaaaaatataggtatgaaacactcaaggatggataaaagaagaaatcacaagagaaaatagaaaatatctagagacaaattaagaacatgaaataccaaaagttaagagatacatcaaaaacagtaccataaggaaaaaatttatagctataaatgattataaaaaataagatactgaatcaacaactttactcctaaggaactaaaaacagagggaaaaagagggacaattaaaagctatcaaaattttaaaaaatgttaaagatagcagtggaaataagtgaaatagagaacagaaaaacaatatcaacaaaatcaagtttgttctctgaaaaagatcaaaactgacaaaattttatctagattaactaagaaagaaagggaatattcaaattactaaactcaaaaataaaatgggtacattactaacaaatttttggagtaaaaaaggggtgtaggagagtaccataagggactatatactaaaaaattgaatagcctaaataaaatgaacaaattcctaga

SEQ ID NO: 99 - DNA, 1831 bp, Artificial Sequence
  Description of Artificial Sequence: Synthetic polynucleotide
acaacctgttcagtcacctgacggtcgcgcagaacatcgggctggggctaaatccgggattgaaactgaacgcggcacagcaggagaaaatgcacgctatcgcccgccagatggggattgataatttaatggcgcggttacctggcgagctttccggcggtcagcgacagcgcgtggcgttagcgcgttgtctggtgcgcgaacagccgattttattgctcgatgaaccgttctctgcgctcgatccggcgttacgtcaggagatgctgacgctggtgagcacgagctgccagcagcaaaaaatgacgttattgatggtgtcacacagtgtggaagatgccgcgcggatcgccacgcgctcggtggtggtcgccgacgggcgcatcgcctggcagggtaagaccaatgagttgttgagcggtaaggcgagtgcttcagcactattggggattacgggttagtatgcactgtcagatgcggcgtgaacaccttatccgacctacggacagtgcgttttgtaggcctgataagacgcggtcagcgtcgcatcaggcaacccgcacaagacaatcccctaaaccccaaccactttacgcaaaatatcgatatacaccggcatcaacgggtggcgaattaacaccaccagcgccaccacgccgatggcagaaatcaacggcgtcagccacaacaaacggccgcgcgacaaataatgacttaaacgatcggttgctttaccgctgcgccataaccgccagcacagccagccaccaacccacacaaataccgccgtcgccagcagcaaccatttaaactcgccgctctgcattccggctggaatatcgatcgccgcgcccgccagaatcccaggcaggaagtaaaacggtggccacagcaggcagccgataatattcggcgtaatgaattttgccaccggcagatccagcattcccgccaccattggcaccagcggacgcgtcgggccaacaaagcgaccgaccagaatggtgaacatgctgtgttgatgcaacgcatgttcagttttatcgagtaatgctttgtttttcttcagaaatgaccagcgatgcaacggctttttaaaacgccagcccagccagaaggagatccagtcgcccagcagacaaccgacaatccctgccagccaggcgtgccagaaacttaactcgccgctgccaatcagcgctcccagccccgccatcagcaccgtaccgggtagaatcaaaccgaccagcgccagcgactccagaaaggccaccaacaccaccgccatcaatgaatacacggtagattgggtaataaagtgttccagcaatgcttgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatggcgctctgtgtgcagc

SEQ ID NO: 100 - DNA, 1831 bp, Artificial Sequence
  Description of Artificial Sequence: Synthetic polynucleotide
atggcctagttacttcaagggcacccattattagagaggaggagattggggatccaagaataaaaagataaaaacctattgcagttatagcaagattaatatttctgcatgtcttttgattcctgcttgaaaggctgcataaataactcctaacttttaagcctgagggttttggccaatggggtttgactctgtgaggcaaatatcaaggatattgtggctgttattgaagaaactcataggagatatatctacatcaagagttgcatggcagggaagcttaaaataatttgtttgcacagaagtagattttgaataatatgacattttggtatattataacattaaaggataaacttacaaatgtcaatgaaatatttcactggcttttctgtcaagcataattaatcataaaagatttttaactgaaatgaaaatgctcaattctaataaataaatatccggtacccagctctattgtctttttgcttaaggcattgtctaccacctacctactacaccctgagtgtctgttaaaaatgtagatttctaggctctacagacgtcccacagaatcactgacctaacacataagaaaaaaaaagattcttaaattaaggtagtgcttgactaccttattttcaaagtaccccaaagacctcagattgcctgttgaaacaagaatgctacatttggtttagctatttttagtttagaggatgagcaaaacatcctattctagccataattatgttagcaggtgtgcaccagataatcaacttgactaaatatccatcttgggttcatacaggcaggatgaacataattaaagttaaaactgccagccttcactattggggaagaaatgctacaggatacagtggactattaaagcaatatttttctgaggaagatctacttatttttctcattagttttagtttgaagtgacacttcataggcatagagtggcagcctacattcggatgtagttatacaggcttagtgtaaagattcaggtccctaatgagacaaagaacattattaggtactctgagtgtgggaagattacaggaaattaaaaatcgagtattctagtttataattctgcccttttgggctaatgggagtaagttccctttctgatacttaaagacagaaatctcttctctaccattcttgtccaaatttccaagtgagacagtcccagtcatgacaagctttttcttacaacatggctttcagttactcaatgaatatttattgagcaccaatgctccaggcagtagagaacaagagaaaacagtacagaacaagaaaaaaaatcttgtttggtgcttacatttagggaagacacaccatttctggttgctccaccctcatagtctgattagaaagcaacatgctaatgataacacttcccttattctggacatatacttctattaattattaggttgttacttttactggaaaccataccaaccttctggttcctattaattctacagtgaagtaaaacttctgagtgtctaggtctaaaaataagagtgtccttaatggtaacctataccaggacagggtagactaacatacgctgggaactagactctcccactaagaaaaataacaataatgactatgggtattggccaagtaatacatgctaagagagagtacagtatactctgaattgagtggtttccaaagtgtctcaggcacggatcatttgatttcaagtacagaacccactcaatgcagcttaggaaattaaaggtgaatttgttagaaggatgaagctatgtctcacagagggcgctctgtgtgcagc

SEQ ID NO: 101 - DNA, 1829 bp, Artificial Sequence
  Description of Artificial Sequence: Synthetic polynucleotide
aagaaaatttgcataacacaattaccatgcttgatttattgaacatatgtaaaattctgccccaatatgcattcttcacaggcacacatggaatgtttactgaaattgaccatatagcaggccataggcagctatcaattactttcaaagaactggtaatattcagaccacatcctcttgccacaatgcaattaggttagaaatcaatagcaagaagattaaattgaaaaattccctatatatttagaaattaaaccacatgtctaaatagcccaatggatcaaagatgaaatcataatgcaaatgaaaaagatgatccatagttggaaatcatccaatccagtgttgtatgcccttgacccagagggccaggtgggaggggccatggtgagggcctgacaagggctctgggaagattcttagaaagattgatcctcaagcaattaaggcaaaagcatccaaatccctgacctgtggagatttcatttttctttattgatctgtcaaatggtctaaattctctcactcaggttgcttcttctataattaaggataaaaatattcctgtgttgcattgcagagtgtcaggaaaatagtcacttgagcagaccttgcaaatgttggctggacgccctcacctgcctttagggatgcctccgggggtatataattcctaagtagacacccatggtttcgtatatggctactaacatgtaggcagggcctctggataccccaggggaagacctttgatgcctgaaggcagctggctgcagtttaatcgccaggtagttcatctcagccatacactgaactgtgggcttacacctgggatgcctttgaattggagagctacaggaagtgactgtgccctgggcttctcttattccctttccaagcttccattcatccactttcaacccacattcatattcctgccttaacggcaagttgcaaggaatgagaggcatatctgtgccaagcactgtgcaaacctgcaagtccagtgtgcacctgtcatttttcaccctcactttttagcatatcaacctggagaaactcgatgcggctttctgcattctaaggcccataatgccaaggtaggacccatcactccaaattattttttaacttattaaaattagaacctaagtctagatgataatctaattccttcctcctaattaatatcattaattgaactgattaatcctaaatgattaatcctgacatgataatggaaacaaagtcaagcctcctatttcctaaatacaaatgactaaatgtagcacaatgctgtgtgagccaaaattcggattatttcagtctcttctggaggatgtctcaatacaaactccttaaacttagagttggaccagctcatgttgtcacaaataaaaagccctgcctggctttctcatttgaagtttgaagtacaacttaatttccaagaaacttagatagcatcacgtgcctctgacaagcagttactagccggtatttactcctcaatacggaataaatttaacagcaaacgaattacatctaaaaccaaatcttgtaactgaattaaggtaaatatgctctttctatacaactaacataaagtttaaataggcagagaaaagaggcatctttacttcttaaaaggcaattttcaaaaatgaattgaagagtaatacatctgaataataatatcaacaaaaagaacaactatcccagcactttgggaggccaaggctggtggatcaaatgagccaggagtttgagaccagcctggccacaaaggtaaaaccccgtctctactaaaaatacaaaaattagctgaa

SEQ ID NO: 102 - DNA, 1829 bp, Artificial Sequence
  Description of Artificial Sequence: Synthetic polynucleotide
ggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttactaattattgtttacatttgaagtgttttatgaattaatatttaattgcatagatgaagattactagttataggcattttactaaccaatactcattaagcatagcgtggattcatatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatggaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgaagtatggcaaaatggaactttaaaacagtatcttgtcaacaaccaagaggacctgtttcacataaagcccacgcattcatctgcctgtccatcattctgtctgtccacacgggcatcattcattagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccactttgacctcctctccaagacaaaacaaacaaaactagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctaca

SEQ ID NO: 103 - DNA, 1828 bp, Artificial Sequence
  Description of Artificial Sequence: Synthetic polynucleotide
agctgggctcctttgtcttcaggcagccgggctgagtcctccccatgcccgcctgtccccacagctgacccctttggcccgcttctgccgtcttcaggcaacaactcccagccctgctccaatcctgatctcttcggcgaatttctcaattcggactctgtgaccgtcccaccatccttcccgtctgcccacagcgctccgcccccatcctgcagcgccgacttcctgcacctgggtaagcgcctctcgcctggcagccagctctccatggccgcctccctcaggaccgcagcctctggtgggaaacagagctgtgggtctcaggcagtggtggggctggactgtgtggcctccgggtgcgctccttgcggcccaagcatcctgcaggacgtcccagaggtcaggacagactgctccctgctctgtctccccaaaccatccccaaacctggaacaggttgtggggccctgcagtgcctcagtcgtctgtgactggcaacaggtgtttctccaggcctcctcaggcccaggccttgcagctgttagcagagaaggccacctgcacccagagcttgtgtagggaccagaggtcagagggaggcagctgggggacccagggtccgggaagctgacctggtctgggtgtagcaggggccgtggggcaccgtatccatggggaggaggtcaggcgccggggcacagcatggcttgtttagacagacgccggtggggccaggccctgggagagggctgggcgcccctccagtgtggtcctaggggaaggagcctgggttctctctcctgaggaggcagcagcgtggtccacggcgcactctggggtgatgatggtgaccattgcaggatggcttgtgggcgggtgtgtggagtgcagccttgcagcgttggggcgggtgccgccagaggtgtgctgcgtggccagagccagggcagacaggacctgctgggccctctgtctgccgaaggcagctcagccaggtggagccacctcgggctctggtgggttttaggagaggcgggaacgcaggctgtggggatggcggcagaaagtggggtcctgacaaaccctttcggatgggaatgcgcagatgcttgttctcagcctggcctgcgagctgctccgcctgctggtgcccctacgtccactcgctcagttctgtgtgatgggatgcatcctcaggacccttcaggaagagagaggccgtcagcccagcctcagctcagcctgggtgcaagaggtgtccgctcctagggccctgagcacagcctggcgccccgccacatttgcctgctgctgagacaccaaactgtgctctcttctggttccttcttcccaggggatctgccaggagagcccagcaagatgacagcctcgtccagcaacccagacctgctgggaggatgggctgcctggaccgagactgcagcgtcggcagtggcccccacgccagccacagaaggtatggccaccacccaccaaggacagggctcccaggacgtgcagctgctgtggcccgtctctatttcacacgtacctgtaacagggccctctctgcgcagagaaggaaggaagggctggggcgtgcttggtggtgcgggctccgcacacaaggctgtggtatgactgcagcggcctcactcacccggtgtgcctggggtacgtggggacacagacttggcgtcccagagctgcagtggctcctgagcatcagcagcacccccgaagggtcctcctcccacccggcagggcgtctgcgtctgtgatgcgatttcatgccccacactctgtggaccacgtgctggctctgcct

SEQ ID NO: 104 - DNA, 1828 bp, Artificial Sequence
  Description of Artificial Sequence: Synthetic polynucleotide
tttttcctatatatacacacccttgacagtttaatttataaattaggcacagtatgatattaacaacaataaaatggaacaacatactatactaaaagttataggaatgtggtctctcaaaatatcttattctactgtattcaacacattcaaaataataaaatattcaagatattcaaaatatcttattgtcttttctgtctacagttgactacagggaactgaaaccacagaaagcaaaactgtggataagggggattactgtacggcataagattcaagtaaggcagactggagaatagccattggagttgcatataatttaggttaatggtgagcattagaataaaccaattaagactacactgaatgaaagtgcaagtgaatagtggacatatttgtcagaaaatacaattgtgaacaatctgctataaattctccatgtatagatgaattgacagaaacgtatggggggttagttaaggacctgtggtcaactcaatcctccagatgttctaggttttagccatgaatcaagtagggccttccaaaagctgtctgggactgcaaagttttagcaactccagaaaaacctcattacgggagttatgctttagcactaagtgactctttctactgcaaaatgctaaaagtatttatttccaggttggcagtaaaaaaaacttttcactacatcatctctgtgaccaatgcagtcagtgttccagactttggtgacagcaagtcttcctgtcccatgagaatgcagcatgcactccttccaggttccattccaatcatgtaacaaacgtgactgcctttttgttgcagcatcagaaagaccagagacacatttgtactccagttccatggcttataacctgcatatgtctacatgccagcattattttatttatgtgcatttcctttgacgtgaattttacttatttctattttttcattttaatccgtggactccataaaggcaaaaaatacaatgtaaaacaaagagaggaatatataaacaaatgactcacaagagatttgttcatcttttgttgattgtggaaatgcacagagcactctggaaacatagctgggagaacagtcgaatggagtgggttaagcagagaaccggtgtggcttggtcctagattctcttgcccaaaacgctctacacaatagctggaaaagactaaaacaacaacaaaacctccctgtgacagaatagtcattcatgcctcaataagggacaacaaatatgccactgaagatgtacccacaagtacattaattagtagagatacatacaatttattttgggattaatgaaaacatgtattacctactgatttagggacaattaatttatccaaagaaacaatgtaataacttaaaccaaagaaatatacatttagtcttcaatgaaattaatactgtagaaatataattcagctgcattaacaatttcactactaatatggagattctacatgattccatataggtgtttccactagaatatatcttgcttttataccttcgcatcattgaaaggattcatgttttatatatctacgtatcactgaaaggatgcatcttttatatacctaagcatcattgaaaggatgcatcttttatatacctacgcatcattgaaaagatgcatcttttatatacctatgcatcattgaaaggatgcatcttttatatacttgcgcatcattgaaaggatgcatcttttatatacctaagcatcattgaaaggacgcatcttttatatacctaagcatcattgaaaggatgcatcttttatatacctaagcat

SEQ ID NO: 105 - DNA, 1825 bp, Artificial Sequence
  Description of Artificial Sequence: Synthetic polynucleotide
gcgctctgtgtgcagctgcgctctgtgtgcagctcagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaggggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttggtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaaga

SEQ ID NO: 106 - DNA, 1824 bp, Artificial Sequence
  Description of Artificial Sequence: Synthetic polynucleotide
gaaacaccaccaccacccgccaggctgctcaactcagaaacaaacccctcctccctctcccaatccacacgtcgaatctctctgctctgtccatctccactgctgccaccccagcccacattaccgccttctccttggacgaaaccatggccttcaaagtgtgctctaatttccctctccccacccatcagcgagtagcaatcttcttaaactgccattcactagccctccgatggtcttgcattgctgctaggccctgcatggctgcctctgcctcgatctccagccccacccatgtcaccaccccctcactgccctcgtctccttgaaagggctgtgcctctgcccaccacagggcttttgccttcttcaccaagtaacccctactcttccttcccatcctggctcagggaagacctggcaatgccaagggtctttcctccacagcagttaatgcatctgtagttgaacatttattggtatgatcattagactaatgcctccgtcccacaccagactaacccccacgaggatagggactgtgtgtgtggctccctagcccagtgcctggcactcaacaaatatagtaaaacaaatgaacagatacagcctcatcctccactgccatcaagaccacctttaccataaaatacctttctcacctcaaccatcaccactgtcactgacatcttctatcagccacatgacagccataacctcaatccctgccagcaccttatcaccaccatcacagagatcagtgtgacagcaacatgtcatcaaagcccttttcaccacccatcctcatgtgcagggtaggggaggacagactggggctacagctgagacaagacaagccataccacaccctgcacaagcccagcgtcacccacctgcctcctccctctcgttgacctcaaagcaggtccaatagtccttctccctgatgcccacgttccggcgatccaggatctccagggtgagctcctcagcagtcatggatgctgggacctgcaaggaccaaggaggagattagcctgcctgtgcctagcccctgctctgccacaaccttgctatgtgactcagagcctgagcccatccttctcaggcccttctggagtcctgggatagagaggggtatttctgagtggtccttaggagcagaacccagcaccagccagatacaggtcccaaactggtcctctcctcggggtagaagcactgctcccctggccatctgagcctgtacctggcccagcctgattctctagccccttggcttctaggtcccagcacctaccttgatatgctgctcagtctctgccttcttctcttccagatacactgtgcagatgaagtcaccggcatgctgcagggagacagggctcagctgggggcctaggaaatgggtgcaggtggcaggtccaagccccccacccaggctccagccttcacctgggtcccactggcagtgccagccacgcgcatcttcacaatggcagtgatctcctcccgctgcttcctgagctcttcctcatccacctgggaaggggcgagaggcagggacaggtggtcaccgtcatctgcaaggatcacccctgccctccactgcccactggccagggacgcacactaaacaccaccacatagtggttaatgaggtcttccaccacacggccagccttgtagtcctgcccatctgtctggaagagcgtgggcccaaacacaattgccaggttgtgcacgttcatctggttcgtgtctgagaagcactgaacactggagaggggaggaggagggctttgagtgaggagtcaggccaga

SEQ ID NO: 107 - DNA, 1819 bp, Artificial Sequence
  Description of Artificial Sequence: Synthetic polynucleotide
ctatgatgttacatttatcatccggtaggtacagaatcaatctctctctctccctctctctctctctctctctctcctccttctctctttcttcttgtaggctatctaggcagtctctgtggactagatctagtataaggatcttattaaagcaagatccaagcaaccaagcgaaagattctaccttcaaacatgaggagatccaagaaacagcatgcactacatcagtggaagccaataccattgagctatgaacattcaggttcttgttctccgtaggggaaactccttttctagattggtatccttagaggtatttgatgcacacacttgctaggatagtctatatgccagtgagtctcctcccataggttcagcccatatatgattcacgcacatgagagctttgctattccatccatctatctgtaggttttaggagaaattcagcaatcctaaattattggtgctcacaggatatggtggctttctctgagacctgggcagtctacataagaagggttgataagggctgtggctagaattgggactgagagtcatttgcatactcacacaatctgcatacagggaagagacagaaaggagaaagcaggtcaaggactctgagaagttgtacaggtttatgtctcaatagcagagctaagcaaggagcagagtccgcctgcttttctgttttatatgcctactctaagaccattctgccagtgatagtgttgaacctgcaagtcctgctgataaatatacatcagggtagcaaatgctaagggcatgagatttgaggaaagagatggtatttttaaggagtcatcctctggttttattcatacattttgtgcaatagtcacctggatcagaacttcttctgggaggctcactggactgttccttttggttagcaagatatacgccttcttctttatcttgactaagactccttaactaataagtaataaaaccgagacttgaacccagcccagtctgactctagaacctatacttttaaccattaatatcagctgatattagttctgacaaataaatgtcaaatgaacactgaatgcaattaaatggtgccttctcattgtcttctttgagacagcatagcatagtggttcaatattgattcaatagctatttattaactgtttatttattagataagagcaagtgttcttttttttgagacaagctctcactctgtttctcaggctaagtgtagtggcacaatcctaggtcactgcagcctcaatctccttggcttaagagatccttctccctcagtttcctgagtaaataggacaacaggtgtgttccatcatgcccaattaattttttcaattgtttggaagagatggagtcttgttatgttgctcaggctggagaagcaggggttctcgatgaagacaacttgtgtctgtgctgtctaatatggaagccactaccaaatgggactgttgaagacttaaattatagctagtgtaactggggagctgaatttttaattttatttaatttaattacacataaatttttaaagatactcaattcaattattagaaacattcaagtatgtttgaaaaaattggggtatgtgaatctacatcttcaataataaattttacaaaatcaaaatatatcaagtatttcaaaggataattgagtgcccacattgagatatccaataagtgcaaaatatgtaccagatttcaaagactcattacaaaaaaaggaaagtaaggctgggcacagtggctcatgcttgtaatcccagcactttgggaggccaaggcaggtggat

SEQ ID NO: 108 - DNA, 1813 bp, Artificial Sequence
  Description of Artificial Sequence: Synthetic polynucleotide
gctgcacacagagcgccgctgcacacagagcgccataggtctagaccgttgttaatttaggaatagacaagtcagatttagaaggactggtttaagagcataggctttggaggatgtcagataagggtcacaaatccatgcttactaaatatgtgatcttaaggaatttgtttaatatctctgttactcagagtcctcatctataaaatgggaatcaaaataccgacttccagaaatgttataagaaataaataaaatatgaatgccaagcacttaaatttagagaccgaaacataggtgctacataaatatttgctgctgaatgaataaactgggtaatcttgggcaagttattcatgaacttctgttgcttcatctgtaaaatgggaaaaaatactgctcaatctcagagttgttaaaaataaatgaaaccatgtacgtatttcatatatgtacatagggcaaaatgtacctctggaatctagtaaaaacctaataaactgtactctttggcaatattattttttaatatttagaaaacaaatgccaaggttcatggtacaatatgagttcagagaaagggcagaccattgtgggtgggagtcaaaaaggaaggcttcctctagaaggtacaactctgaattacagttatacaactctgcaggggccactttacctaccctcataacccattgttaccagatgccttgtagcaaatggaaaccaaggtgccaagaaatagtttctcgcaaaatcccaaggagttacacgttcatgggaaagggccatgtgagttccaccaatggcctttgcattccctggtgaagggcagtgaagcataaaagattactttgtttttgtgaacactactcctgcaaaggcattattttatttcctcagcattcatctgcttcaattatatagttcacatttggtttgttggtggtggtggtggttttatcttggatttcttcttttttcaaattggaaatagctttatattttcttctgatgatatgtgacacatgctcatgattattaatcaatagggaaaattgaaggagaaggtaaagatattggaaattttccctacaaatcagaatttctaaaagagaagtaggagaggccctaacttcatgcagaaatcaatgataattaactttgatccctatagcagccaatagaatcttagctacaactctggtcatgtcattctcatgtttaaaaaaagtttggtttttttttttccccaccaggacagtcttagtcttgagcacagcatatgaagcccttttgtgatctgattcttgcccaacttgtcactttccaccattctccctctaccattaattctatgttctggccacagagaactactttaaattctccaagtgttcccttcttacctttaaagcctttttcacttttgaattttacacagtggagaactaagctaacaagagcccctcttactataaacacatagaaatgctagataaaatagagctaaaaacaattttaataaatgctgggcttaaaaaaaaaatacctggtaccagaacttaagaagaatttgaagtcagaattgcaaacttcctaaagacttggtggcttaagaggatagtggacatagatatacgtcctaaaaaatatgaagagtaattattcaaaaaagagcaggaggtgtggtgttgactgctagttaagtccaggagctggaatttgatcccccttttcataaaacaagggcactgaagggactatcctttcagtaaaagaattcaaaagaatccacccagcaaccaaaacaggc

SEQ ID NO: 109 - DNA, 1806 bp, Artificial Sequence
  Description of Artificial Sequence: Synthetic polynucleotide
ggcaaaagacatgaatgggaactcaccaacgaagacctatttatacagattaagggtatcattagatactattccccaaaacacactgaaaatacataaagaaagaaagttggacaggcaagaagaaatcaacaaaaataccagggtagaggagatcgttaatcaaacttccttctctttgagactcaagcaagcatcaaatacacaatggaaaaactggatgaagcaattgtttagctcagtttaatgggtatgtatcaaacttagtacctacaaagaatccacattctttccaagtttctttgggacagtttaagaaaatgaccattctctagacagaaaatctcaaagaaatctctttcaaaatgagaaaatttgtagaacacatccgttgaccacaataatggatatttaaaacaaaataatactcaaataacaataagaatacatttatgggaaattaaaaacattaagcaactcttgaaaatagaggaaattaaaagtgtaactatggaccattaagacaataacaatgaaaatacatcttaagagatgtggtcaaaattgaactcaaaggaagcaaatagccttgaattcttcaatgaatgaacataaatgagcagaacatcccaccaaaaaacaacttgaaaagaaaataataaattaaaccttaaaaaagaaggcattactaaaaacataagtatcaattaatcaattagatacaaaagaaataaatacccaggagaattgataaaactgagaactggatgtttcaaagaccaaacaaagagacaaagttctagaaattctaattcattttaaaaataaatgcatgcctttaatataattaaaatactttgtggtatagtagtaaataatcagatcaatggaatataatacaaggtccagaaacagagctaattataatacatttaatgattttaaaaaagcttaaataagcatagaaataagatattggaaaataattaatttaaaagccccatgttttgctacctcagacctcacaatgaataaatttcaagttgattaaagttctaaatatataaaatatacccataatctggaaggatgtatgagtgaattatcaatactcgttagagtagggctttctggacaagaccacaaaacagaaacctaaagaaaaagattgcagaaattggctatatatttaaggatatttatttattcaataaacaaataatgtctcctatgtccaaacactgtaagaggcacttagcgaatggctatgaacaaaacccacaaagattgaagctctcaggtgaaggagacagaagaaaagcagtagtaatagttaattcgtaagtaagcactaccatttgttagatgatgaagtgtacagctcatagaaagcgataagaataaatagacccatagcatggtgagaagattgaggatgcagagaatgagttgcaattttatataatctagtcagtgtaggtctcacagagaagatgacagcggtgacagccttgaagagatggagggagccacacggctgtctcagagaagcgtgttctgggcaggaggagcagcccatgcaaggcccctgaagtggggacatgcctgggccacaccaggaatagcaaaggggacctgtgactggagatcggctggccaaggatagacaccaggcgataaggccagagaggtgatggggcagaaaaaaacatggcaggatcattgactttagtcccagagagatgggagccaccgaaccgacaaggggcaaggatctgttttgtctgaatcgggtcactctgtggc

SEQ ID NO: 110 - DNA, 1801 bp, Artificial Sequence
  Description of Artificial Sequence: Synthetic polynucleotide
aatgaaagacaggggaagtagagtttgaagaaaggattaattgaacctgaggatggattggatattaaaaatgaatgaaaagaaaaagtaatgatgactaaaatttctagactggataattaggaaaatgttaatttctgatgtaaaagggaactcaggaaagagtcaacctaggacaaaaatcaaaagacctacatatggaaagaaatatactgatttgagtgaacccaagcagagtttgaagacacagattcaaaggtatttgacaacaaaaaaaggactgtgagatcaatgccagagacggggactcaattttgcatactgcttatatactgcctacgtaaaggcactttatgataaagaacatctcaaaaaaataacatatagaacaaggggcaaaaatagaggataaaagagatgattcccaattattggtcaagtggttggagtgagaattaaaggcaaaattcctcttctccccctcaaaattacacacaactacacaaacatatgtgttaatgattttagtgtgttgaatctggctgcttccacactgcatgcatcctatctttctccattcacacctgagataatctcattctagtgaagtcttacattataaatgacaacaccaatatttagggacgttcctcttttttcttcactgactttgcctttccaaacaatatactttgtgaatcctctgagaaaaaagaaagtagtttgatctgctggtttttaggacaataatttttaaaggacttgttatttttggtacagacaccatgcaaaactcatcttcaatcaagggcaggtgccgggtacagcatcaagaaagtaacaggtggtttctcttcctctcctttcctctaaaactgaataaaacaaaagttttagcatttcagaaataatctttttaattaaaagtggaagataaatgtgataaaagttttctttgagctcttgaaaacaagttcattctataagggttagaaatagtattttttatctgtcactagagccattgtactgtggggcctaatgtttcagattttggatactcatttctttcgattgaaggtgtcatcaggtgttttccacctttagtgatctcaagtggttccccttcagttgctaaaacatagtgtgtcgtttgagcagtccaatagacccacagagatctgctatctatattggcagataaatgacagcagatggaattgaggctgtgttctgtctcattggcaagcctgcagccttagaagaagagatgtgcccctgaagcattatgcaggttgctcatccagaatcagagtcactgtcatagtttgtgaaagggaaattggcaaatctctatacataataggcaaaatgcaaccctctcaattctcaaaggcatattctcttcactcacatttttgtctttttgctgaagggaggtttctgggccaagatgttttgacagcctggtattttctttttttgcccaatgtgtaagaagataattaatgttaccattaatgcatgcaatgacattagaatcaattcccttagtgatatatatgcactaggaaatgaacacaaaagttaattaacaatttattgagcatatactatattacaagtttactatactatacaattgtgcttttttattactattggtgaaaataatgaaagatggcacttttctattcttcaccatatacaaggcacagttccaaggatttaaaatctatcaactttatgaatctttacaacaggaggagccaagatggccgaataggaacagctccagtct

SEQ ID NO: 111 - DNA, 1800 bp, Artificial Sequence
  Description of Artificial Sequence: Synthetic polynucleotide
gtatttttagtagagatggtgtttcaccatgttggccaggctggtctcaaaatcctgacctcaagtgatccacatgcctgggcctcccgaagtgctaggattacaggcgtgagccactgcactggctcaagtctaccagttcttaacttgtgctttcctccagacctaccttcgtacgctgggacagtatccatgggtctcacttttcctgaagcgggacagttaagtggctgaggagggagtggccctctagtttctgccccatacctagctgaaggcttcaggataaggagaataatcactggtgagcagaggaaacctatttctgctctggaaatggctcttctctccctttctcttcccccacctccccctgctaccccccagagttctgtaccaattaatcagcagacaatggaagctccagctgggaccaagtgggctggactcattagagcagaatgacattaatatcaaaaatcttttgagacaaatgcaatgattcagggcagacgcctatggagggctggctcagaagctggtgtgggtgatggtaccgtggtccaagacagagagagccgtgcatatgtgggtggacaaccaggccgggtccctgggatgcctgaggggaagagggggcaaagcagctctgccttgggcagggtccctgtcctcttgtgcagcctgacttctccctcctccctgcttggggggcctgcatgggtcactgagtcaccgaaaccctgggcaggctggagaggcagcggggcatggaggccttcagggctggatgggctggggccgggtcccagctgcatctcctctcacctctccctgtggctccagcaactcgcttcctgtctttgggcctctgtgtttcttcatctgaactatggggtgataatagctgcctctcaggctggtgagaggatcatggaatgaggtggacacattttgtagaatgtggactagaggggagcgaagggcatcttcaccatctcctccttcttcattgttctttaccaagtggggataaatatcaaaagtctttctttaggggcaacaggaatcaaaccagctcccgcagggagccttagagatagttttgcttggttcctatgctcttcatttcttcactcactcagatattcattcattgagtcatccactcacacgtgtaccgagcacctctcacattggcatggatgtggcactggggataaaaaggtggatgggacaccatcgctacctcggagggactcttcggctagtgaggaggctcttcctgcctggaggacacgcgtgtggtcagggagagctttgcagaggagaggccacaaagctgtccttgtggtttaaggagtttgccggtggcctggggtggggcagtagggacatcatttatttgaaaaatatttattgactaactactacatgccaggcactgtcctcagtgtggggacacagctgtggacggcagagatgaaactctgccttcaaggagacggctttctggtggaagggcatagaagccaccgagcagtgagggggcagtggcagagctgctgtttcataccggctggtcaggacaggcctcggcgagagatgccatctgggcagagatctgcaggggccaggggagtggcccacagggataccaggagcagaggggatggcgggacgcattcctgaagtggaggaactctctctgggctccgggaaaagcaggacacccaagctgcaggggaggtggggggcgtgaggtacgatggggtgcgggggtagctgcacacagagcgc

SEQ ID NO: 112 - DNA, 1795 bp, Artificial Sequence
  Description of Artificial Sequence: Synthetic polynucleotide
ttcaagaattgatcaataactgacagcttccctaatttttgttcctgcttccaacttaggaccaaccagagaaaaccaattatgcacccgtaaccaatcccataggataccacacttctagttagccctatagcatcctcatgccaatagcctccaaccagggcatatctgaagtcttccctttctgcaactataaagcttttccactcttctgcctgtatttgcatctctgccaaaatggaagtgacagttggtggctctcttgctgcagcaagttctgagtaaacaggctttgtttttctcgtttgtttggtcttcttttactttcacaaagcaaagcagcatttagaataatcttactttcagaggtggttggctttggctagctgacaatagagttcctagaactgaaatagttgggcagcctatcagagtccaaattgatctgtttaagcaggaaaactctaggcctagtgaacagaaatctgactgaatcacacagaatactcacagccccagtgcagtctcagacttgagtcagttcacagtcccaggactccttgagtgaaaaggagaccaaacgactttaaaaaaggacgctgaaagaataacaaatacttatattgtgaaacttctttcagcctttactaaaggtacaaatggtcctttattggtcactatttttaattagaataaacaaaatatgtatttttaatttggcaagtaattacatgtccaattatgataaagtacattttctttgtgtggggtgtatgctaggttcaaaaatgattcgaatattaagattcaggagaattttgatttttgaactctaactcttccccaggtataaaatgaacatagataaatagtgctaaaatgtgagttagatttttaggtaacaatgtaaatgtaatacaaatttgaagcttaggaataaaaataaatagcgtctgattattttaaagtaagtgcttatttatgtggtttccaatgtgacttaagacatctgtgttttttcttgtttgcttgtgtgtatatgagagtgggaaagaaggggagtgaggaggaggagagagagggtggaggaaaggcagaaagttcaagaatgatttgtttgagagatgaagtacgttgcatagataagactatggtttgtttaaaagtatattaatttctgtaactatgtaacagagcatcccaaatttagcagcttaaaataccagtttattgtctcacagatctgcgggtcacaaatcctggcacagcttaactggatcgttgtgctgtaatagcgcgtcaggcaaggtacattctcattaaggttcacctgggaaaagctactcttccaagctccctcatgttgtctgtagaatacatggttgcttgtttcttcaaacgtagcaactgagaaagtctctgccctcaggtaggagtcctttataaggatttttccctcaattaagacaggctcaaccaggacaattcttcctcttttttttttccttttttatcttaaaatcaactgatatgaaaccttaatgaaattttcaaactttcttcacctctactctatcctattggccagaaggaagtcacaggtaccagctgtactcagaagaggggatcacatagtttataacatattggggtcacctaagaatgtatctgacataatgtgatataccagaaacccaaaggataagtggatggaaagaaaggcaaagcaaagaaggaaaagaagtaagaaatcagggagggaagaaaggcaagcaagcatttatgaaaggaattt

SEQ ID NO: 113 - DNA, 1795 bp, Artificial Sequence
  Description of Artificial Sequence: Synthetic polynucleotide
ttcctttcatatagtcaatggctgtttacatgttatcttttgtgcatggctgatacatctcctttcactatgccttgttattttgtatgatttataacaatttgatattaaatcatctcacttttctttagcctgtaatattaatatattgcatgttctcctggtttttcaagtacccattgactttgtctcatcttatagaaggacaattgtgatctagcataatcaagatttccaattttttttgtatatgctttactacccctgtttaggaattccttctcttctccgtgaatatgagaatgcatattttctggtaagatatttatagttttattgttttgtagaattagcgtatttatatatctattttttccttaatagtataatatatagaatctaattttagtctataaagatcataattggatttatcttgttcctgaaaataaaaaaaagattttccacggagataaaataccactagatagatcgatagataagtagttagataatagatagatagatgtatgtatatgtgtatatctataggtatatatacacacatatatatgttcctaattatattcatttaattattatggtgtgtttatcatttcttcaagtatatattaaatatcaatcatataagatattgtacaatgcattccaaggaaagtgttcaatgtcattattctataagtttcctactaatgcaatattcttcgggaaatatgatacatttaattcaggtttgaattatgttgtgcctgacttgtagatacttttaaaatgcactactacagtacatctcagttatttgtctttgctttgagctgactcatcctgtatatgtcctggaattaatagttctatgagagttgaaagaggttggaataaaaagcaactgattttcaagatttagtttcctgtttgataaccttatcagtacactaccagatgttacagtaatcattttctccactgaagcagctgtgacttttatgtggaatacctaattggtcatcatgagggctatattactttcagctgcaggaaaagtcattgaaattggattaaagtaagaactgggttattgctatatggggccctaggaagctttgagcacttttaattgacttggaaccaacaaagaagaaaaacagctaggtaagttcaaatttgtgtctgcccttcatacttagaacatataagaagaggaaaatctagggagtgttcaagttcaaaaacaaatcaattataacaataagaaattgttaaaaaatgtgttctgaggttatataaaaatagttcagtaaacctaaagtaaaatgaaacttatggaaagacaactaaaactgggtagtgcaatagagaggatgggaaaataagttaatctatttttattgtacattttctcaagccttatactaggcactttaacgtataatatcatattttatgttcacaggaatcaaataaaattaaatggaaggagactgttctatgtagcatcttcccaacaactttctctcatttttttctggcatggcttaacagaattagttataacatgaatagattttctgtcccttagaaccttagaatagtttgtaaacaggtttttgtctatatagatataaacatctggtgtcttgaatattatgctgcatcttgttttctaaaatgcattcactctgcagaagcaaataaatggagcaatgagatcagttaagttttagatagtcttttaaattatttacataccaagttcatgcctatgtaattcctttgt

SEQ ID NO: 114 - DNA, 1794 bp, Artificial Sequence
  Description of Artificial Sequence: Synthetic polynucleotide
gcttgaaaatagaagccacatattctgaattttagttcagttaattctggcattgagacaacatccacctcttgaagttaagcaaaatgtttccttagccattttgcaaacatattttaatcatgaataaaatatgaatcattaaaagtaaattattttgcataatttttatcctgtttatacaaatctagaaccacctgttttgcattaaaggtttttaaccctattaaaaagaacaaaaattaattttattatcatagccgctaaaaggcacacataatcttccattaagacatggaagcagcacgagcagttccatttttagatgctcttcatctctaattctcaacagctctgaacattagcttaatacagtaattgacttccagtgcacctggcctggcaggtcttgttgaatgagatctgaaagtgctcaattttacaggtcatttaaaaagtattgtggtcttgctgatttcttctggacacaagctgcagcggctccctttccctgcagtcactgctttgcttagagaatgacttccttgagaaccctgcaggaaagaggctggctttagagctatggctcctgcagattctgagaggggtctatgtattcttggattgctctgtaaaatattcatataatatattatgagcatcttaaaaatgagcctacggtattcagtgtaatggtttcttgccggagaaatggcttgggtgaaaaagagataaagactcttagtgctgggaaataatgagatttacaatcctttctattgatttctgctgataaggtatgtgataggtttctcagccattctataaggattaaaaattaatctactttgattattgtcattatcaatatgcttcttaattagtaacacttttctctgaaagaatctatatactttaagataagaagggcacacagagaagtgatttttttttctaaatcagttttgtaaaacctgaaaagttttatgatctgactttttgtcttctcccagaattataggtcagaagcaagaatttagagacaaaagcagttttctttgtgtaattcaaccattttataggctttttcttgccatccacgtgggcaagggcaagaacaaggatgaaacaagctcatgcttaattcccctacgcccaaaatgacacattattcttactcatattctatgttgaaatgagtcacagaaacccacgtagactcagattgactgacaattttatataggcatatgacacacgcaggcgttgtaaacaataatatcctttgacatattcacagacactttttgtttactcattattttttctctcatgaaatgaaggaaaaaacatttcaaacacttagtaatagctggtcagctgaagtggccagtgaaacaatcaaacatttgcagtctcagccatatgatcacttagcttaagtatgtcgtgcagccaccactgggaagagcaacctgtttctattctcctgttctctttttaagcgtaaaatttaccttttcaatgtgcagtcctgtgaatattaacaaatgcgtatagtgttgtaaccattgccacaatcaagattcagatcacttccatccccatttcctctggactccctggctctcctatggtttcttgatttcttggtcttcatgcaaaacatagatctggggagaaaactagtctaaaatgagaatgaatttctttttgttcttaaagcacaatttggactgctggtgcagccttttggtctccagtttcccttctgctctgttcccctttccctta

SEQ ID NO: 115 - DNA, 1793 bp, Artificial Sequence
  Description of Artificial Sequence: Synthetic polynucleotide
gcagggcacagcctggttaaatccaaactaccatccactctgcccctgattccatgtagctgaacacacttatattagcatataaacatggtgaagtttttctcattttttaaaaaagtcttctcttttattttccaactatgggctgtcccatttactcagacttctatgaaacaaaactttgaagcatctttatcctgtcaatatccaatttctttgtcaatccttctctcttaaatttacttatctggctttgacttttccacttttcagaaactactcttgtcaagtatgccaatgacgttcacttggctaaatctaatggtcactttcagtcttcttatattagaccattctgtaccatttaaccaagatgagtgttcacccttatccttgataacttttctgtatacacctagctttcaaaacatcacactcttgatttttctacccctccaaaatttcttttcattttcttttgctgtctgtgctccttctcaccaaactcttaatatttcagtgttcccagttcaggaattttatgttttctgtctgaatccagccctaaggagacaccacctatatgctgacaatatccaaattaatattttcatctgagacctctctgcaagacactagatcatatataattttataacttcctgtgtaatatctctacttacacatctaatggctttcaaaactaaacatatctgaagaaaaaaaaaaacccaccatgctacactcctttattcccatctcaggtaagagaaaatctatcctctagttgctcaaaataaaaactttttttttctgtttcattttgaatagtttctactgctctcttcaagttgagtaagtttttattctgtcatgtctaatctgccattaactccatttagcatgtttatccctgagtcattatagttttttttctggaagtttgattggatcttatctatattttctatgtctctatttacctatttatttaaacatatgtaatgcagttataatagctatttcagtgtcattttctgttaatctaaagtccatgtcagtgtttattgactaattcttgccattttgtgttgtgtcttcctgccttgagtcatacttgattatatgtcaaacactgtggattttaccttattgagtgctaggtacattttcattcctgtaagtttttgagctttgttttggcatgtagttagttacttggaaacattttgctttttttcatgccctgcttctatgacttttaggtagttctggaatggggctgagtctctggctaattattctacactacttgagcaagagcttcctgagttctctactcaatgccctacgtattatgagtttcactagtctggttcataggaataagcattgataccacccctattggaggaatggccagtatttcctctgtccattttgaaagttctcttccaagatgggagtagtttcctctgatgtttgctctgatgaataactttcagaaaactcaaggtgaaccatctgcatatctccagtgttctctctctctgtgcatctctctcttttctggtgatctgttatatttgtctgttctcacactactataaggacatacctgagactgaataatttatgttaaaaaagaggtttaatggactcagagttccacatggctaaggaggcctcacagtcatggaggaaggcaaaggaggagaaaggcaagtcttacaaggcagcaggcaagagagtatatgcagaggaacttctttttataaaaccaatagatctca

SEQ ID NO: 116 - DNA, 1789 bp, Artificial Sequence
  Description of Artificial Sequence: Synthetic polynucleotide
gctgcacacagagcgcctggggcatcgcctaaaagacctgcttgctatcacttgcactgtattggaacgcttagatgatacgggccactgagtgttggttgggtagggcttcctgtccacgggaaccttttatattcccatcccctcctcttccattcccaactagcctcctcatcctctgggctcaggtagtttgcccacagattttattagcacttaaggtactgcactgaggtggcgagcttccgcggtagggcagcatcatgcgggaaggaatcatgattcaaacccaggctctgtcactcggtagatgatgttgagtgatttgtgcaagctctgtgcctgtttcctcacatgtagaatttctcttggaaatatgttatcctgcataaatccccagtggtgtggcagctccaaattaaggtcagtgttcccttcacttaccggacacctcaaaattagtaccttgtagaattaaagaatccaccttggaggctgccttccagaaggaataatctgactcttgtccaggttgaacaagtttactgggaacaaaacaactgcctctgggtttatgctcgtctgctcttttaagcagtgaaatgcttgtgtccaggagccaagtggcagtaacctttgtgacttcaattcttccaagaataggtgtttcttaatagccctgattgaattagaactcaagtcccagctggttgccttccactggccagaaactggctcctggaactggctcgatggcctggcccgactatctcaagaaagctgcccctcctgcccagcaactgggtctcatccaagggcaccttgtcccattgctgtgttcctttttatgagaaccccatcctgaaactgcataattgcaagcttagaaaaaaaatagaattgccataagatggggcaaaattagaatagcttttgggtttgaaagttaaaactcattttaagtatgcacagacaattgtctgagcttcttctcttgcaaacagaagtcttggggagctgaggtgagtttagacaaataacaatcagtcttccttttgaagtgagcagggaccagactgtgcccctctggagagggtctatgagtgccccagtcctgtccagactcagaagagaaaagaaggccctgagggcacaccaggaaatgtgattcagccaaccatgttttgagtgcctactctgtctgtgcctgagggctttcgttctatctaatacatgggaccagatcacagacgggcagcttcgagaggtgaacaccaaaggggctcttggctttccgtgccatttccatagagttctccttcagctcttagccacctgcgttgaggctgtgagggcattggaacagcacagtctcccagtaagaccacagtgtggtggtcaagggcagagactccagagctggaccatctgggctatttctagttctaccacttactagttctgtgacctcattagaggctaagagttaaggcacatcccttaacctctctgactcagtttcctctttggataaatgggtgttaagaatagtgcagatctcatagatttgtcatcaaagaataagtgaatcaagtgatgtgcaaagcagacagaacacaagcgtgcacataaacacgtaccgccatatgcatgttggttctacaaaataaatacacatgatttgcttctatttattgataaataaataggatgtttcccttggcgacacttctggagctgggctctggaagcgtgactttgagaaaggggaggggacagtgggacctga

SEQ ID NO: 117 - DNA, 1787 bp, Artificial Sequence
  Description of Artificial Sequence: Synthetic polynucleotide
aagagaggcgtaaaggaagcagtttgatattcacgtctgaaattaaggagagagacctgggctggagatacacatttggacatcattctcaatacacagggtagtaacagtcatgagaaagaagactgaggactgagtggtgggacatgtcaatgtgtgaaaggtaggggatgaggagaagcaagccaaacagactgtgatggatggactagaaaggcaggagaagccaggtgagggagcgagatcctgaaaaccaagagagggaagtgctgaggagcagagagttagagagttctctgttgagtcaggcgttgccgataggttgagtaaaacgaggtctcagaaattaaggctggatttattaaagtgaaaatcagtggtaaccttgagaaaaacaattttggaggagtgatgggagggcaaattactggagtgacttttagagtgaatggaaaggaaatgtgagccccttgagtaaggcagttctctcaaggtcatcatacctaagtggcatgatcatgaaccatctaattttcttgcggtttagctgcatttttcgaatcttatatgagtatacagtctaacactttgaagatcttttaaattaaatacatatggcatttaaaaaatgcaaaaccaaggtattataagtttataaaattacagaactaaaaagactacctgaacatttctagattatggaagctgatcatcattttgctcatagttataattaaatatcacagaaagactaaaagtttcatgggcagtattttgtgcttgataaaagccattcaactctaggatattttatcctcatcaaatatacagagtaatgactcatattaaaatactgagttccacaacaggaataaaaggggatcaatgaaggaaacaatcttattatagaaactaaatttttgtaaattatataatatgaagtccttaacgtgtatgtattcacacaagtcatggcttcctgtaggatctagtcccagcactgaaggtgtcaggtgaaaggaatgacacactactaaattaacattcaagaagaatttaccaatttcatttacccacagcgtatgagaatccctttttcctcacatttgtcaacactggttatcattttttaataaaatattgatacaattgaaaaaatggtacctctttttttctgcatttttatggtcaacaggcaaggctgaatatcccttgtaaaagtgtaaaatttgtcaatcatgaatatttgcccaaatttggattacttttatagtacagtggaaatgatctactgttaaatattgctgtaggcttacctatcacactcttcctgctctgtcctaggaatttgctgaccatcagtttttccattctctccttgttgaattaacccattatcaatacggtcatctgtggagacatcatgtaggtttcttgatgcttctgtttcattccttgcatgtgtcttcctttctccctccgcctttagtgaaagtttcatagataggatacttgttatcattttattcattgaaaaattgttctgttttcattgattttatcgcttcacagtttaactttcacaattttagtcattaaaatattttgtacttatgttatcattatatataggattatatatagaattataagatataagtagcataattttatcactgacatttgtataaagttagcttcatttctgtgtgagtgaatgtgacaggattttccaaaatttcaaaagggctcttctaaatttagtccttttatttccatccattctt

SEQ ID NO: 118 - DNA, 1784 bp, Artificial Sequence
  Description of Artificial Sequence: Synthetic polynucleotide
aaaaaaaaaaaaaaaaaaaaaaaggaatgaaagatattaaggatgaaatggccggtaggtggcccagagtgtctgtctactcaaagcctctctacgatacttgatactgccaaggtgcagaagagccaggaggcaggcatccagtgggcaggaggggctggtcccagaactcagcttgcctggccctgcaccagaacagaccagggttggtgtagctggggaactggggcattagacggttctaacctgatgccacgtgcatttgctgcctgcatttcccatgaccacacccgtattctgagttccacaagcaacttctggaaattcagctccctctgcacatagtccgcaggacaagaatatgccagacacctaaagatgaggtcctcttggaaggaacggggcatggccctctaggtgacttacaccccaggctcgtgggcttggctcataagtctacttacgagactggcctgctgcctgccagctgctggggcagggcagctgagcctgccagcctcgctgacccggccccagattgctgctcacagtacactcccctagtcctttctcagaggagctccctctgcagcaccttctacttgaatgtccttcctctgagagtggagaggagagcagcgcctgctctctttccagagtcttgaaagagatggttgagatctggaggagtctgggcacaggaaaggcccaagaaatgcaggcagcaacactgcccattcctccttggcattttggggtggaaaccttgaccctgacagcccatactgccctgctgcctgcattcccactttcatgatcacaggtgggccttgcacacctgaggccctccaggagtgcttggcagctgagtgttctggccccactgcagggactctcacctctgcacagggcgcagcccagcagctcctcctccaaagtaagcctggaagtaagttttactcacaagtctgcagggcccaagtccaagtgctctctggtgctgtcccagcccgaggagtcagcattttcccagtcatgccctcagctccgacctgctagggctccccaggataccaggcagcctgtggctaccatgttgaggggagggggcacttctggggctcatgagcagtttggtttcaggctgttttttggaaacacttctctttaatgagtgctacagagtgcttgggtgcaaggagccaccaaagagtctctgggtacaatgacccctgattagatggaacactcagagaacgggagtgagtctctgaattttctaattcatcagagatgcccatgactttatagaaacagggtctttcaatactttttattgaggtgtctggaagtcatgtctttgaagataaagttgaggggtctggggaagaaggatcctaggggagacatgagaacagctttgaactatcccaaagtctgtcattctcacgagccggcagaccaactctgtgactccagacaagggccaggacccatccggaaaacacaggcagcaggtgttggtcccatgaagggaggttctgatgcggaggagactccttaggagaggatgagaggtggaggaagtggaggaggaggagagaaggaaagagaaggtgggtgtgtgttgtgtgtctgaatatgtgtttgtattatgtggttgcttgatgtacaatttgtgtatagtgtgtgtatctgtgtgttatgtgtgtttgcctggtgtgtgtgcagtgcatgtttggtgtgcagtgtgtgtgtctgcataatgtatatgttgtgtgttt

SEQ ID NO: 119 - DNA, 1782 bp, Artificial Sequence
  Description of Artificial Sequence: Synthetic polynucleotide
tagtacttagcacataaaatatgttaggcaagattctaagccacttagacctttatgtacagaatatgtaacagagtaaaataaataacacaaagattcattgacaatgacaaattgacattttttcaatcatattagatgatattaaaaccattaacaaatttactgctttgtttcataattaaaaagaatgctaaataacttcattaaaaagttcgactaattaggtatatagataaatgggcaggatttggaccagaacacagaggataaaaattttcaaagaccagacaaaattatttatttattttttggggggagagatcagttttattatctggggatacagtggggtcctctccctgggaggtgggtcttccactggttatccccaccagggctccagggggcgccatgagattcagtactgggctccgctgggggctgggccttggagaaggcgaactgtgcagggaagcaacagctgtggggtcttcaccgcccgctctgcccagctgcacccggcctcctggtgctcctcaggctcccgccgagtctgtgtctctggagggcagcgaaccatcctgcccagaaccttatcctcacattccagtttgacgcaggtcagccatttctgcttcctcctctcaggctggactttgcacttggctttcttccagtccttcctcgggccacttctctgtctgccggagcttaaattccagcctcacaaatgttccagatgggaagggcgtgtccagggcgctgtccacactggtctcccggaaggcccgctgcacgggtgggtgcttgcagattcctccagggccacctgcaggctccggcgctggcccggtgagctcggcccctcccgcataccccgcgcccacccactgggccagcaagatctgcagccgtctcaggcttcccctgtcaccctggccctgcgaagctggtgtgcgccccttagttctccgagcctgccaggagccacctcctcccctgccctgcccctgtgggggccatgcccgcagaacgctgggcagaggcgaaggaaccaggaaatgtccctttctccacactgaccttggggtgtactgggtcttctccactccctcccaccctgcccgtgctgttccctggggcccgcagtttcagcaaagttccctaccgcgccgggaagccgtcctgttgctcactctcacccttcctcgttttctggcccattctctctccccactgggtctctcacaagaccttctctcctcccggctgtccccggagcccctctctgcttcctcagctcagccccttctctgatggcttctccctcccacccccaagcgaatctccaggctctcaaggggtgcccccgatccccggggcctaggtcaaccagacaaaattatttcaaatgggaagatttgaattccattgaattcatgaaagcaggaatccatctggtcatattttaaataattttgaaatgataatagcaactatcaatttaaccagaattcagaatacccaccattttaccagaaaaaaaaaaaacctgttataactaaacaactaagtcagtaaattttcaggatacaatattaacatatgaacatcagtggcatttttttacagtaacagcaaaatatctgaaacagaaataaagatagttccatttacaatattatcaaatagaatgaaatacttaagaatgagttaacaaagaatatgaaagatctgcaggctgaaaactataaaatgttgaggcgctctgtgtgcagc

SEQ ID NO: 120 - DNA, 1774 bp, Artificial Sequence
  Description of Artificial Sequence: Synthetic polynucleotide
gggaatagtggggaatggatctgagtgtgccaactggcaaatgaccaatataaaaaattcacaaaaagtctctggccctacttatttcacaggatatcagttagaatcaaatgaaatgatacatgtaaaagccctttgtaaattacagagagctatgcaaatgtacgctggtatattcacgttttatctggcagtcaaaaaaatctgcatttagctgttatgaattctctgctgacctggatctgaagtggagtgtggactgactgcttctcgagggatagtccttgaggtgtggacgtccaaaaggctgccagggatgtctgggggcacatggactgtaccgtgtgatacaaaaccttcctgcagaagataagcttctgggcacctgtctctaaacctttcccatcagaccagttgagtgcacatgagcatggctcgtaggcacctgggcatggaaaaggacctctccagctctgcccttcttggcagtgagcagttagcggccctgaggaatgaagccacagccgagtgaaggcgttccatgctgtccaggtgatggagggaggaaattgaaaagacattcaagagtttcctgagctgagctcttcccctagcatcatgctgttcatactacacatgttgttttgctcctgatgataaaggagatgctagggtaatagggctgacgcagttgaaccctgtagtctcttcagccccattaacccacatccacccaaatggattctcagccagtcccattaagacatcctgtcagaaccttcccacgtcatttgcagagtgaagtgaatatcaataaaattgtaacgagtaattatcccagcttcactgactcttactggaaatgaagccagccctctgctgtgggtattgacaaaaactccattcctcctgggagctgcttttcttccgctgggtaaatctgatccatctcagcagataccaggtgtgctagtttaacattcatgggcacatgggcagcaggtttggaaaggggactctagcccctgtcccttctgggcagtgagcagccctgatgaatgaagaggttcactgctctccacgctgcgtcaacagagcgagtgttgcaccaggaggcagggcacctggcttccccagtcactatcgactactcccaccgtccaccctaactccatcaggcctcattattccatctataccacaataggtcctttccagttctggcattctatgagctgagagacagaacagccacagagaaatcaatctgccagagagtgatgcatttgacagtgtagacactcgaggcccggtctacattgccaggcatttgagaagcagacagaatgggagctttgctggcagtttctcaccgtggctttctgaccacagagagcccgagcatcacacctgctctgtggtcatgacagccagcactgggataccagagctgtgagtgacaaggtgttaattcaaggcttagggagtgtgatggttagggactggcccaccctttcctgttctctgcctgctgtctgaaaggctgtcagcacctcctgctgatggctggctgctggtgacttgctgcctgcttcccccacatgaaagtgtggaacacagcacgaaggtgtttctgcagcacctgggctgctggcttggaacgtgctacctgtgggggaagactggaggactgctcagttgctgttctgtgctgggattccagcctcctcttcctggctgctcaggaaaagacagcacaggccaagctggggtt

SEQ ID NO: 121 - DNA, 1771 bp, Artificial Sequence
  Description of Artificial Sequence: Synthetic polynucleotide
ttgaactcagaacatattagaagtgagagaaacctaaaaaagtatgtagtatacctccactttatatacgaggaaactgggatctagagatactgcttttgtgacctgggctgtttgaactgaaggtatcttacattactaagacaggtgactttgtgtgttacagctgacaacaatcccccttgaattatcaggtttctaattaatttttttcaagccttaaaggacagtatcattcaagcttagttgttaaaaataaaactaataattgttggactacagtggtaaaataggaaagctctgattagaaaaaggaagagaagtgataaagaatacatttcataataatttggggtcaccatctataacccaaactccctttgaaggacggatgggtttgcatagagagaatttaatgtaacacttagagtttgaggacaaggacagcaggtctggtactgctcttgagtttccaatcagaaaatgatcactgtaacggtacgtcaatttaataaccattagatttactccaaattagatattttcatgactcatatctgacatccttgctgagagtttggcagcaaacgactgtggcagagcccccaagtggacgatgaaagagcagcatctgtagcagcagtgagagggcgcaaatccccaagtctaccagaggagagagctccgggctgaggaaaccctgccaacacggtggagcttccagagcccaataccagagcctgtttattacacagctaagaaagaataaaagcgatcctttgaaatgttggtcatccctcaaggtatgttttttaatctcctaagactctgactgatctctctactatggttttttgcttttttaacatccaagaggataagatattctgccccaatacaaacctgagggatctgacacttcagacatctggcagagattctgcttagaaagtagctctagattgaaggctattatcccaacgtcacttcagtcaaggtgtcctgatttgctttgaatttaatttcctttgattggaatttttgaaaaaaataacaagaataaaaagtaataggcttgtggaagtggaaggcatgccaggtttctgcatctggtagctcaaacaaggtgagactttgaggccttgggaaggaaaagaaggcagggaagttgctaagacaactgattaaatgacaacctgatgaagcagaaaattctctaaatccaaggtgaagaattgcctcaggaagcaccaaaatttccatcagacacacattgcaaaaacaaaggtcacatcctatccaatttttaattttttgtttttgacgtgtgaagcatgcaaattagaagaaaatgcaggcaattatcaagatcacttatacaatacctatcaagatcacttatacaataccaatcctgtgccaatacatcattgctcttgctttatgcttttgtggattcctcaagattataaccagcttaaatcccatttactacttgtgctcaaaaataacattcatgtacttaaaagtaacttcttactgagatatgttagagaggaaaaattaaaactatggttatttttactgaaagttacgaataactatcttaatgattcaatggaaaagatggaaacaagaaatctgactgatttaacaaaatttgctctctcctacctaaagtaaaaagcagaatgagacacattcaacttagtcggacccctgacagaaactgaatacattttactgacccagagggcgctctgtgtgcagc

SEQ ID NO: 122 - DNA, 1767 bp, Artificial Sequence
  Description of Artificial Sequence: Synthetic polynucleotide
gtgcacaggacctggagcatctctctttggattaagccccctcctcaggattacagggctcttcatttttctcaacaggctgttgtaccagataagcacaaaaacttaatttcattatgctttgctttttttaaaaaaaaaaaatgaaggtaataattttaacaataaacatattacaacctgctacacatgagacccttcttgtgcttcgacctttcttctcaggagtttatatgtattacatatattcagtttttttctgagttggaatgcttattacagattattccccttattacagattactcttttaatttatctcttagaatgatttttcgagagcccctgcctgcccgcgcctggtggaatggagcggcgcctgggctgagccaggcgcgcaggggcctccgcacgtgccgcgccggtagcagacgccaagcgggcggacagtgagcgtgagaggccgggtcggagtggccgccggagcagtgccggggatggaagaacagcccatcttcaccaccggagcacaggtcttccagattgaccccaacaccaaaaagcactggatgcctgcgagcaacaggcggtcaccgtttcttacttctatgatgtcacaaggaacatctatgggatcgtcagtgtggacggagccaaggtgaccataaacagcacaatcacaccgaatatgaccttcaccaatgtgtcacagacgtctgggcagtgggccgacagcagagccaacacggtgtttggtttggggttttcctctgagcagcagctgacaaagtttgcagagaaattccaggaggtggaggaagcggccaagacagccaaagacaagacccaggagaacatggagccctcgagtaataatcccgagaatccgggcatggagccccatcttctactccggcatccagtgtcaacgggacggacgatgaaaggcctctcaggccgctgcagctgacacgcacctgcagtctgggaaccacaagctgaaggcggcctcgacgcagagagctgcccacgggaagaggtgggagatggagctgcagacccggcgggagagcgacgcccggctgcccacggcgctgcaggagtcggtggccagcgtggagcagaggaagaggccgtgagatccacagagaggagaagaacacgcagctgaagaggaagatcgaggagctggaggcggagctccgagaaaacgagaaagagtggaagtccccaaaagcaaagtaaaactactcctcagctcaggtgagtgcaactgtgtctctgagaagatggaggcggcagagagaggatcaaaacctggaagacaaagtgcgttccctgaagagagacactgaggagagcaaatccagacagcgccacctgggggtggaggtgaagagtttcccggaggtgctggaccggaagatccacaacctgcctgacttccgcccaggccttgcatactgtgcaccaataactagggctggccgaggcccaggcccctcctgtgagtcccaagcgtgtgtgcgagaccagatggcgctaggacgttccctgtgtgcgttgcttctgtaaatgcagacgcagtttgtcgtgtttccaaaccagttgtgccgtccactcactcctttccagagtagaaatctcctctccgccgggcgcggtggctcacgcctgtaatcccagcattttgggaggtcgaggcgggcggatcacgagatcaggagatcgagaccatcctggctaacacggtgaaaccctgtctct

SEQ ID NO: 123 - DNA, 1757 bp, Artificial Sequence
  Description of Artificial Sequence: Synthetic polynucleotide
gcgctctgtgtgcagccaagcagcttagatgagtttcactacataaaagaaaaaaagtgaaacaaatgtgcagtgagtaagaagctggtacatttcagtgcagtttatctcagctccaatcattcaatctgataggtggtcaactgctcagtagccaaatggactgttctcgactccggagagaggccacaaattatctggcttctataaactcagacaagatttaactggtaagaaacaaataaagtattgaaataaagtattctaatcaattcattaggagaaatgggggcggcctctgtcaggcatgaagatatgaaatatgcgtcataaagcattcgtgtgtgagtgtgtgtgcgcgtgcatgcgtgagtgcagatacatgtgtgtttgtgtagtgccaggcctagaagatagataaaaataacacaaaagaatcactgagtacctcagatatctttgaaggagcacatggaccttgtctcgccctccccaagtgcccaacatatccatgcggtcagtgccagctttgcacagttaaaataaagaaaacaaatatccaaatatccaatatcattgctgcaagctggccttgggtctttgccgacatctgacctgcttcacataacctcctggcctctaaaaatagatattctgtggtacatataatttttatacgatgactaatacaggaatgcccttcggggtaacttagtgtcttagtttctctcttttctctctatatttatctatgtcttcactggcctctttaaataaaagttagtctgtagccatggatcaagaacattagccaagaaattatttatctatgccttaaagggctctactcttcttatcaacataagagttgctcatattttttaaagggggcagagggatggtctcagacctgttttgtatttctctgcctttacatatcacttttccagatccaacggtcagtcagaagaggtttccacccaccccactccttttctattttatatacaactgagtcaaaaatagaaaggtaaattcttggactataaaaatattccttatattaatactacagcttgctgctctaaaccccaataagaagggtagtgtggtcattcacaaccactggaatcttactctgaattttactttcgtcctctggttgagtgagagggaggaagacagaggaagacggcagggggagggggaatggaaagtatgacatctgttcagatcccctcattgtccatctggttcataacccaaacttttgtccggaggtaggaattccagaaactgaaggagaaagtctgctaggggggaaaataacagagatccattcctgacttcccgtcacctttatttcaataccagtgacctctccgccacctcccagtgacctctgtgccacctcccagccgattagctctgcgtgtgaggatgtggagagatgaattttcttatccagtgatgtccttcctttgaaaataacattctccctcctctgttgccatcaaaacaataactgcttaatgtcagtgcactaagcaaggtagtggcaagatccagggtgcccagagacaacagagggcaaggaaagcctgggaaattcatgccctcctgttcatgctcccctcagctcacctgaaggcctcactgtccccatactacaagctcatcttacaagagccctttgactctgcttatattgtaaactacaatcccttgaggaaagagatcagaatctacttgcctag

SEQ ID NO: 124 - DNA, 1751 bp, Artificial Sequence
  Description of Artificial Sequence: Synthetic polynucleotide
ataatgaacgaataataagatacatctgcagcttcaacttcttatttaccaactcacatatcttgttgccagtttagcgtttcaagttgattgtctcatgtctcaaacttcagaaatagaaacagaactattgatttatgttctcaaatctgctcagattgtaaatctgtaaatgtcagtaaatgacactatcatgccttgaattactcaaaccaaaacaagtagtttactattcctatcctctatgccttgctgtcatctaattcaatcccattgttgtcatctttacatatatattaccattttgctctctagccgtcatctcaactaccatctattggggtaggtgattcagacataagcttgaacttacaagcttgtatattttccattcctgcagtcttgaaatttgccaggctcttgtaactcatggtgattcctaggtggggaaacttccttgcagggacaaagtaagagtgctgctaaactagaagttgggactagcagttgactttgggcccttctccagtgttctcagtggtaggtttagtacagctaagcatggtctggtatcacagaaagtggtgtctgttgggatacttttgaataaagtctacaagcggacagtgcaggtatttctttggtggtttctcatcctaattgcttctaccacgtttaggcaagatgagtatgagtttgcctaaggttaacaagattagtgatgcattattttgacactaaccttctgtggcttccagcctctctttcgggctattcctgagtcagggcaaatagtcatgaactgtgaaggtacagataggagcagtgcctcgtatggcaaaaagcaattgagattacatgaggcacagctacgggaaatcttcccaacgctttgatgttatgtgtatagggctttgtggaactctgcagatgcctcaaaattgtctactatgcaaaaagccacaagtaggagaaatatcctattctagaatgtcttcagagagtactacctcactaattaatttatgtatagccatggaggttcttaaagataatgtggacccacacaattgaatacatgctcaggtccagaatatcataacctgaaattcaatcttctgctggtttgtaaaagaagagagaataaacatctgcctgcccagggatgaagaaatccttctgtaagttgtgccataattaccgctggatagaagaaatgttttgtatcaagaaatagagaaagagaatggagaaaaaagagaaaattaagaaagagaggaagagctcaggaaagatggggaagttgccaagaattgcaaatgattactcaaaatgatgagtttactttttgtgcaaatataccactcagtttctcatggactgaaatatttgctggcaaacaggaaggaacttgtcagattcccaattttaacaagaagagaatgatgaggaaatgctctgatgacaactgtctatttgaggagtttcacagtaagaagttgactctgactacacagtgcaccagcctccatttggctgccatcatgggagccagctgcacaagggctaccccagaaattggaggagaaaaatatttgccagatgaatagtaagccagacgtagtgaagaggactgcttgggtcagatagaaaacttacacaagagttacctaaacttgagcagaaactttaaaaaaaacaaacaaacaaaaaaaacaaaactctacaggtgatttctatatatggccctg

SEQ ID NO: 125 - DNA, 1747 bp, Artificial Sequence
  Description of Artificial Sequence: Synthetic polynucleotide
ttattcatattaagaaacagatccagttttgttgcttcaggaaaaatgtgctgtaagaataaatgtgtcttaaaatttgtcagacctggagagcagactttttgtccacgcatctcttctttcatctacccttctatttgccaactaactagctccccgtcaattgtcaattgccttagctcttatgccattatcactctttcacatacaaatttggttttggtttgcatggcgcccactccaactcaaggcctttttacaattacgcttctttttttttttgtattaacatctttggctagcctttggattgaatggtttaggctgaggcaagtaaccagcacttttttctagacaattgtgttgggaaagtcacacagtgttgaacatggccatttagacagtaacagttaggtttccagaagggtcccttaaaagccagactatggggagcaggctattatgccacttaaaccttgtcttgggtagaaaaggagatataaaacctagaggagtgcattgtgtcatacatatggaaactatatgaaatataatgcaatgatttttgcaacgtgtgtcatcaaaaaatagttatgggttaaaggtttattacaaaagttagatgaacattaactgttggcaattattcctccaagggcataaaatctcaattaaacaaaaccaaatactttctcctttttaaagtgctgttttaaaagtatacataaaaggcatatacatcatactagaatgaactacatgcttatttatagttactaactcatgacagggagggggatttaaaataagtaaagttaggagagttagacttgcctccgaaaatatggtactaggaatcctaggagagttacataaaattttcttctttcctttttgctcatttcagtatcaagtatagagaaaagaaatacgatacttttccaatcaatattttgaatccattgtactatattctttgtttttccttctgctgcagtgtgtatttagaaatatattcaccattgaagaggagctggtcagagatcttgctctcaccagcacattttatacaggtcgtttgtccagatgaccatttcccatagcctatcacagctatcttacgatcttattccatttcttgatagtattcttaaagtcatggctcctggactatttttccctgctctcttgccactgtctgcatgctaacaccttttacttttgaatcagacactattcattgttgcaaactcaaggtcattttgtgaaactgttctgtactcacagatgtccaccctgaatcaaaaagcattatgattaaatgaaagaaaaaacaatcaattagttaagatatttctatcaatttgggcttaccaagttatattttattagatatgcaactttaagtaagccacctaaaatgtaaaccaatttcaggtgaaaattattgaatttcaatcttgaagaaagtaaggaatcttcctacttaagaagttcttcagtcagtactgcagttcgtttgctaggagactttgaaatataccagaaaacaggctggctggcaggttggtttgtgctgcaagatattctgacaacctgtcaaagttctacttttctcacattctaccaacttctcttttctaaagaaagcatgaaatgtcaaaatgacaggtgccgaagcacagcagcatccagcttctgggtctattaccttaggagggaaggagctgaaaagttgtgcaagtga

SEQ ID NO: 126 - DNA, 1740 bp, Artificial Sequence
  Description of Artificial Sequence: Synthetic polynucleotide
gcgttttatcagtatttttaaaaggcttcatctgcctatccccactgaaaataagactcgactctacctatgatccgaacctcagaatgaatgagaaagtccagagaggagcactgtgtgtctcctgagcacccctaggaagaggtacatgtcccctgtcggatctaccctgttcattctgtgggtacgttagcccagattcttcaccctgagaacattaagccctgtattagtcaaagtcaagctaaactcctgtggcaagttattccaaaatacaatggctaaaactatagaatcttctctctaaagtaacagctacatggtgagccatccaggttggagggtggcactgatcttcccggtcattctagacttgggttccttccctgtcactgctccagtggccccaaggtccctgtgggggtctgcatggtagaagctggggtgccccaagtccaacaattccgcctggtggaagaggaacaggacctggctaagcagttgggattatcacctcctctcccattccattggcaaggccttgggcgcccaccgggggagctgtgtggtgaagtgtggcaggcagtatatacctggctgcagttctgcgactgtggaggaatttccagaatctgcaactttgattttcattgcttgcagtctcttccacaagccctaaaacaagagtcactctcaactctggtgcttggggacagttctttattctaacccagaaagatgacctgagtgactagaactcagaataggcacctgggagtcccttaattagacacagggggtttgcagccatagttctacctgccgtgttgtaacagcgtcaccatcagctgctgaggcagggcaagtgacttgctgctaataacataaagtactcatgtctgcaaaccacttactcttttaactaaattagagagtaatcaaggttagccttttaataacatcactttcacttatgaaaaaccatacaagcttcctgagtggaataaaaagggagagtgatcctagcgggctggagcagccacgggtgtgtgtgtgtgcgtcggcaaagaacggcaaaggtgaaggattgcagtagtcaaagaaatctcacaggaggcagtaggttttaggggaaagagcttgaatgtgggcatcaaggaacttgggttctggcttttgatatgtcattaactaagttgaatgaggacattccttgaaagcctatagtgtgccaagcacatgcccagtgtgggtcttgggcaggccacatgacatctctcccttgcccatcgcctccaccctccgcccccaacaaaacagaatgttgaattcatgtcctctgagactttcttcagctctgctacaacatgattctaggaagtagaagctcaccttctgatcttgggaagcaaaataactgcggaaaaaaggaaggctgtacaaagaaaaaaatcccagtcacatatgtggtcttcctggcaagagggcatgacttgagtccaatcgcaagaaaatttcagataaacctaaatgaaaaatgctgtatttttaaaagtggggaggtggaattgtgtgcttccaaagtgtcaatgccaaaaaaaaaaaaaagaaagcacaaaaagggcatgaaaatgttgcaaatgaatagaggctgaagagacaagataatttaacccaaaacctgactctaggctggagcctgtaaaaaagagaggaaaattgtgttttgaaaaaaaaaaa

SEQ ID NO: 127 - DNA, 1739 bp, Artificial Sequence
  Description of Artificial Sequence: Synthetic polynucleotide
caggaggattgcttgagaccagggatttgagaccagcctgggcaacatagtgactctgcctacacacacacacacacacacacacagacacacactcacaaacaaattagccaggtatggtggcccagctatcctttatggcagaggtggaagaatttctttagcccaggagcttgatgttgcagtaagccatgatcctgccactgcattgcagcctgagtgacatcacaaagataccgcctcaaaaaaaaaaggtaaatttgtataaaatatgtagctctaaaggactgagaataacaatgaaagttgaggaagagattcatggaaaataatagaaagtccagtaacagttaaacacatgtatacaatcacttgatttatgaatagtgacaatgccgtgtagagggattctatattcttatcagtaaatgggagtaaacactaactcatagggtcactgtgagaacttaagacaatcagtgtaaagcgtcaataaagtacccggtgtacttcattagcaatcaatttattgctcctgcttcttgactcacagatatttcttcaattttatttcattttctatgacttcaggccaaatttctcagtttctttccctgtaatgtgcccataagcagcatttttttctagatgtaaaattgctttattcaacatgtaagcctccttcccctcatttgaacaaatgtgtattctatggtttaacgagatcttcttttctctttggatattctagtctaaccattttgatttatacttgtagaaactttgtataacttttataactgcctatgatcacaggaattgccaaataaattctttagttagaggcctaggtaatctatctagagactcatagtttgaatgatatacaaacggaagtgatgggctccaggtgattaaaacactatttctaaaacactggaaaaaatcaaatttacctgcagaagaagatcctgactatgcttgcctgctgcttatttttgctgagcgaaatagatttttcaatatacagagaaaaaaacactaaaatgtcatgtgtaatgacctaagccaatcttatctgctttcttgtatttctttagagtagatcgtttttccctaatttaaaacatttaataatacttaatgcatgaaatagccacatgaaaggacaatctctgattgaatgtaagaatgataattgcacttgttgctgtggctgcttcaaaccatagaaatgtatgagagtgctacttaaagcccacttcctgtaaacatggaaaacagataataagaaatggtaaactggaccaaaaaacagtccatgagtaaaatacttcatttttgttccctgatttccatgacaactgaactggtacacatatttatttatccgtttttcttacctaggtgcctataaaaatcaaatcatctttaaattggatttagatccatcttgagattggtgttctgtacctaaataaaaagcatttaccctttcaacacatgtatataacttgaagttttattttaaatgaccaagtagaagaacagtgaacccgaaaatcagatagtgttgtaaaaacacattatttcaagcattctttcaattcacagcatacagaatagtgaatgcacccaattgatttctattttcctccgacaaaattactattttgttttactacccactgagactgaaaacaagttcaacagaacatatttaaagcaactttctgttc

SEQ ID NO: 128 - DNA, 1735 bp, Artificial Sequence
  Description of Artificial Sequence: Synthetic polynucleotide
tgcctactgataccttcgctggttagatcgaggcattccgcaccccatctgaaaaatgtttaccagaagaaataactcctcagtttgggtaatctaaaagcctgcaaagtgacaatggcccatctttcacagcaggcgtaacccaacacctatcctcagctttaagaatccaatattaccttcactctgtgtggagaccgcagtcctctggaaaggtgaaagggctaatcctactctaaagaagactctagctaaatcagaggcctgactatctctaacacccatagcttactgcagatttgaactgctccaaagtaaaacgtataattaagtcctgttaacatgtggaaggcctttcctaacgacagatctcctaatagatgaaaagactcatcaattacaaaaatatgtcatcaatctaggacaggtgcaaaggcactccgtgcatatggaaacaagcgtcttcccctcccacatgggaggaaaattcagtttcagctcagctagggatttagtcttactaaagacgtgggaggaagttctccagctgagcagctttccccaacgtggaagggaccacgcaaggacacctgagttctccaacagacgttcaacgccaagggattcacaggtgggtgcacctgtgtggaagtaaagctgttgcttattctgggagcccaatctgaggctgggggaggtgggcgcggggttattttagcgttggcggagcactggccctgtcgctgcgctcctgctcctcctcgcgtttctcctgccgccctagtccagcagtggccatgagggagatcgtgctatggcagaccgggcagtgcgggaaccagatcggtgccaaggttggtggccggggctctgagggcccagcgcgggcctgccgggtggcccgagaaaatgttggcagcggctggggctgtattgcggcccctcgtctccgcgcctgggacgcggtggagctgggtggctggctaggcagccagggcggacccccagggatccagcggcctgggggtggggataggagaggggctgggcagcctcgggctccctggcctccgtgactcagccctggcctgtttggcccctcgtgtctctcgcagttctgggaggtgatctctgatgaacatgccatcgactctgctggcacctgccacggggacagggacctgcagctggagcgcatcaacatgtactacaacgaggccagcggtgagacccctgtccttccccagccgccctcctgggaatggcggccctctcctcgctgatgccctcccgcccccgtcaggtggcaggtacgtgccccgccctgtgcttgtggatgtggagccgggcaccatcggctctgtgtgctcagcgccattcgggaggatcttcaggccggacgacttcatcttcggtgagctgcaggtgaggactggggtgaggctccttagccagggccgctcaaattcaaggagtgccccaaagtcatcgctgtgggaactgtggagctagggcccctgaacaccctcccatcctgagtcacgcaatctccttctcctaaacgggctttgggaggaaggcccagctgtctgcctgagaggagctgctgatgcaatctttctgcagggagctgggctgggggcagtggctgctgcttttcttggggatgggcaggagccacctgcagccaggtctgttgtgttaggctgtctcaggttcggctcctgacttaact

SEQ ID NO: 129 - DNA, 1731 bp, Artificial Sequence
  Description of Artificial Sequence: Synthetic polynucleotide
agtttaattagatcccatttgtcaactttggcttttgttgcaattgctcttgttgttttagccatgaagtcttttcccatgcctatggaggactggaatttctatcagttttaatcactatgttatcccggaggcctggaatattgcctaaacagactaagcactcagtaaatatttgttgaataaagatcttcatccttagagccctaataagccactgaaagctttaaatgtgaagagtcataatcatatagaagattttaaggtctctctacctgtccatgaaaaagaatgttggggtagagtgggggtgcagtgctatggataagagtggatgcctgggagaaaatgagcttattaccaagaagagctagtgccataaactgaagaaatggggtgtactacccttggtaatgacgcagcctccaaaatgctcccacccccttccccagtgagccacaccacccagtattcacatccttatgtggtcccctcccatgctgaatgggggctgcccctgagggaccaactagatatgacagagccatgctgaatgacttcccagaccagaaggaaaaaggctctgccactccactttggtgttctggatcactcactctcagaaccctgaactgttgcatgagaagtcttgctaccccaagaccatgatgctagaagaatcacatgaggaggccatagggacaagcccgacactacataaagggaaagatgccataccagtccctagctgtacaagtctccatctatttaaatcatcccagctgagaccccaggctctgggaccaaagacatgacttccccattctgccatgtctgaattcccgaccctcaaaaccaaaaaaaaatggtttaagccactatgtttgggggtagtatgccaagcaaccatagataaccagacactcagtgaaggagcctctttggacagtgggatttcaccaaccaggcacaggtttagagtcaaccaactctgaaggacagaatatctcaaagtgccttttgtgttgaagagcctggttagaatgagcaaattgcatcactttaatagaaaaatgcagctgcttccaggtagttcttaatataaactgtcaaaaattcaacggactgatgttctccaaacagatttttattgcacctaagtccttcaggaagacaactatttgtttgattcactaagggagctctggattaccatgatactttcctcttctaaccgtctggagaagtttaatgtaatgtatcctgttagagaacaaattggaatcaccatgatcttctctgaggaatgatgagttaattgcttgctctaaagtttgtcaaataattaattggaactgttatttcaagaatatttgatgcctgaaacttttgtgcttttctatacaaatcaaagactaaattatgatatcagagacttatatttataaaaatggaaatattagccaaatgaagtcctcttttaaatcatgaacagggtatatgcaataaatagcttaaagtaaatgaccaaaaaactagtgaaagtacattgaaatgtgaagacaagaagaggtcagagagttttacaagggaatatcaacctcttacatagaatccaagcatagctagctattctaggagtactaattaagatggcatcttggaaaggctatatatctgctataaatcccaccttcaataagcttctgttagattactactctgccctat

SEQ ID NO: 130 - DNA, 1731 bp, Artificial Sequence
  Description of Artificial Sequence: Synthetic polynucleotide
agccaagttaaatgacagcatgacttcaggaggccagatttgagggcttttatctaagatgcagcatcggagtttggtttaagagagtaggaagtgatacatttgttactcaaaggacacttctcttttttgaataaattacctgcagagtttaggccaaagaggtgggcaaggtagatttgggaaactgttgcttgctaatatcaccaaacgctttctttttatacttggtggaggctttaattggggcaaggacatttttatacaaagatagagaaaacaatcacctatggaatttgattccttgctccatgccctcactagcacctctcaacatgcttgatgatatttaaaatttattcatagggaaaaaacttttcatcccacaattagaatcaggcttaacttgctttttgaaaaggtagtatgcaatttgtgttaagatctaaattaccaagatttttatatcttgaaacagatttagatgatagagtgaggtcggtggtggtggttggtgggaaggggtagttttttagagagggtattaagagttgggcttttcaatgtgagagaggtgaaggtttgaaaataagtaagaaaagcactaaaagggtgaagtcaagggcctcagagagccaggatgatagattctatttcacagtttaacacaggatcaccatagaccaaagcaagtttataactaaggcaatgaagatcatctgtctcctcccttccccattaattgtgaactttagttttataagctcctaagaggcagaaaacaaattggagactcgtcatctatttgggagtgtatggcatgtatttattgtcctaggtgctgggtttatttttttcagctaatgacagttttccatgctttatggtaagtgaccataaagtaagtggtaagtgacttacccttcaggcagttcagcccaggacagtcagcagaagactgtttccagatcccacctgctagttacagatcatccctgatagagcagagaggggtgaccaggtagtgactttatagtcactggaggcaaaacccatttttggacagttcattgagggcttacagacaaaaggttcacaaattatgcagtgagctggatggagtgtgaagtgtatttatgggtcgtgcacatacataataggtttactttttgagatttgaaaacatgttttaaccttaacataggattcccacctgatttaaacctcttatttctctaatgtcagacaaaaatgtgagtatgacatacaaagagaaatacatcaaggacttttcatcctcatagtttgccagtgatggtggagagtgtcagaattggggagtagcctaatcaaaccttcttgctctgcatgcagtggcagacagtccctttgctgttcctttggggcatgcagactaataaagtgccaccatcattttatctctcagtgagtagttttaatgctactgcagtggtgggagcactgggtgttgtcgtccacacctgaggacaagcagctttgttttggatcatgtatctgttattgtgatgtagccatttatttttcagggaatgatgccaaatgatgtttgtccctttgctttacatttttatagctaggtctttgaagctgaactggaggaacttcttagccaatactgtcttctcaaaccaaaagttgacagttgcagaagacacattttttagtgtcatggcaaccaagcaacatatt

SEQ ID NO: 131 - DNA, 1730 bp, Artificial Sequence
  Description of Artificial Sequence: Synthetic polynucleotide
gctgcacacagagcgcaaaggagaaccagttttgtgttttctgatccttgtttgacaaattacctctctccccacttcattactcccacccacaaagtgcttataaaaaaagattcatgacacaatttcccccttaaaaccatgtcagcccttccccttgataatctaatttgtcctgtcatttggatatcattcaactagactgtcccacctaggtcttctgtaaatagaggtcacatggctggcaccgtgaaaatattctatatgtcagacaaaccaaaggatgagcatagaaagagagaagttgacgtttgtgataagatgacgcaccctagttggcatagtcaattccatcccgccaggtcacgaatacctgagaaacccgaactcaaatctacttggtgcaggattcaaagatggcaggatcagtgcagaatcctgggtctgcctgccctatgagccccatgacttggggctggttttctggtctctctgagcatcaggttcctcacctctaagatgaggatcataatcccatctcttagggttcatgtgaagattgaaataagataatgaaaatgcctcataaaccagaagtgctatccagttcaagaggcatttggagtttgatttggggttttcgtttgaggtttcattgatctgaaaggtgtttattggggtggtctcccactcatcttgattcagggagcttgtggtgctgctctgtctgaaggagcatctttctgtaagcctcacttgtccccctgtcgggtagcagacgacaagctgggcagtcaacaacgcaaaactcccagaccacggcggccttggggcatcctgagcatttcacatccatgacgtagcaatcctggctctggaccaggcgtttcttgtttccacttctcctctggagaggatgagggaggtcctttgtgagaggcatgttctcatgaggaggtcgtcacttgccccaaaagcaggagcatttggttttcagccctcagagggaagtgggcccctaagagatgagagtctctttgaccaattttgtttggaaaccaggtcatcctggtcaaacacctcagagcagatgcagagcccagagcagcctctttggatgaatgaagtaggaaccaaatgaaagaaaagccccaggtaaagcagtgggagtgcagtggcagatcatggaggccactcctctcccaggactccgttccgccaggaccatgcacagcctgtgcttgctgcctgatttgcacacatggttgtgatcttgaatttgtttcctggtgaaaactgtgcttctcaaactctgccatggcctgtctctggatgaggcgaaatggcctttcttaggagtgtttcccagtagtttgctctgcaacagatttctctggaggaggctgttagcactggaactgccttaaagataaagactataatagagtccctctgggatgttttcctggcctgttccctctccccaaacccagggagaaccctgactcagttaggcactcagctcccaaaagaactggtccgtttagtcagttccttctcgggggagtcttagaggctaagcctaggcagccatgttttggcatatgcaaggagaataattaaaaatattactattattacataaaataatagcaatagctaactcttacctagcacttcccatgcgccaggcacttcctgaacactttacatggcgctctgtgtgcagc

SEQ ID NO: 132 - DNA, 1729 bp, Artificial Sequence
  Description of Artificial Sequence: Synthetic polynucleotide
ttctcacttccacagaggtttctgttgtttcagagagcactcttctcaatacatctgtgcacaggcgttcccatttcagactccacttctcaggagcccagtctaagacagtaaccaatcttcagacttagagcttcacttatggctgctgagtgctaacatagaactgtttggtgatgcaaactgtgctgtatttgctggagtctgagcagttgattatggggtctttagaggcagtatgaccaagcagttgactaagagtttgggttctagagtgagagagtctgagtttaaatctcagtgtgggacaactcaacttctgtgcctttaaaataatctacttgcctcatgaaattttactgataggaaataacagcaaaaaaggagcaaaacttagccatagtgattttgagtgaataattggaagtggtaacaagtaatgttcctacccagattatatcaagagcaaaataattataggatatttacttatcatttaaaataatttaaatcaatgatacaatcctctaagtgactagtcaataattttatttttaagatattactctgttctgtgtggggctggagatttggcagttacagtggggaataataaaataataaaaaagaaatcaattttcttcatcactcaccccacaaaatatttttgcttacctttgatgggtgggtagatgggtgttttcaaggatggcttaacgtatacattttccaaaaacaattgaaatgaaaacggaaacattgccagtatgagacaccaggttttatgaacattagcatatacttatttgatcaatttttcttaatgtactaagaaattttcatcttttttatccataaataatgcgtatttttgtgtttaaggtctggagatgagaaaacaaaagagtagacagtaagtgacctaaaattttaacctctgatttaaacctctgtatattggcgttatcacaataatttttagtcatgaataatttctagcctgaatcaaaatgaataaatacatattacaaaaaaaaggagaaaaagaaaaaaaggagggaagggaaaacaatatcagtgaatatgacataaacacccatatggtcaaaagattacttcaaatgcatttaggaaaaaaaaagggggggtgttctaatcagctctcctgggtgattgatttttagtcgtttctatgcccttaccacatggtatctggtgcctgatcaattattagtttgaacatggagtacagctttttagagagctatcaacccccttgaagtaaattgtatcctgtggctaaaatttgacatggttcaggaaacacatacattgtatattcttcagcagtgggttgctatttctcagacccctctgaggcatttacatcctcagtgtttgagccaaacttttgagggcttggattctttgaaaacttcaaatgctctgtgctgttatcagaccagtggtgaaactgatctcaaagtccactattaaaactcccctcaaagacattttcattagaactttgtacatgggcagttcaaaagatccagctattggtttttgttcagaagtcttgtctccactttcatattacgcaacttttttgacagactttcaaaacccacaaactgtgggctgcctgcaattccagccaggattttatgctgctcatttgatttcctccggccacatccttctcgtgtccttgtcaacattgcaagga

SEQ ID NO: 133 - DNA, 1728 bp, Artificial Sequence
  Description of Artificial Sequence: Synthetic polynucleotide
gtaaagatggagtttggaatggaatctggcctgtctgactctaagccctggatccactgtaatacattataactgctagctttgcaaaatgcctttttccttttctcatctattttcacactcaaactaaaatttagtaaactaaattctgagcagcagaaaaaattttagtaaaggtcctctcatccttgaagaacttcttatataaggatactccttcttgctccctttcccacgcagaactttaccaaaggtcagtaagaatgggctgttgtgttttctctcaaatcctatacagaagtccttaattccgaggtaaacatctgaatggaacaaatgagtatgatctgggggttaaggcaattttcaagtgtgtgtatgtgtgtgtctgttttaaggcataacaaagtccagagattaaggccgagttaaaaaacaaatgaggacaaaccaatgaggacaaaccagtccgctgaggtgcggccagagcagcagcaactgtggctgctttcttgataaaggctgtgaagacggcacgttttactcttattcgtgtatttcttttgacactttacccctctatgaagcctcagaggtgttttaaaattgtgttaggaaacacacagagataagaaaaggcaaatggtcctgatctagtgtctcagggaagaggctggaaaggaaacgcggcgcgagtggggtgggagagggggcctgtggttttgcttctgtccgggctgaagactgagtaaggtagggcccctccttctgcggatgggtttctctctcattccaccctccacccacctccggttccgcgtgcacgcgcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgaggtacggagatttatctaggctcttccctggctgcgaacccaggctccctccaggtagcgtggaatcgcttagaagctgatatcccgaggggcggtgggggtggacagctccggccaccagtgcccgggaaggagggcgcggggctgcgcgtagccgctggccagcaggttgtaaaaaattaggacagctaaatgctcagggagtcgtccagcactaaaggaggctaagacctgttgacgcctgctatggcagcgcttgagaaatgactgggggagtccagcgaggtcggggacgcagcggtctccgggctccagaaacctccttagccttttgtggtaactttggtccggcggcggggggccggtgagcaggaactggagggaggcggtggggaaaccgtggatccgtccggctgagggtgcgtggatcagactgggctga

SEQ ID NO: 134 - DNA, 1728 bp, Artificial Sequence
  Description of Artificial Sequence: Synthetic polynucleotide
gcccacaatgatgatatgccaaatagagttctcacaacaatggatgctggatggagtcacatcagtgccattgtcaaggaagccctggaaatgtaaaaatcaaaacagtgggtaaactgcaaggccaacgtctgatgatcacattgcaaagagaataacattttaataatattggctgttggttttgacagatcatcagaccttaaaagaaatgcaacaggatgattacagacaaagtcattgtggaagagctatgactagatgtttttaaaatgagccataatccaaaaaaaaaaaaatgctttccaagtggatgctaatcgaaatgccattaatgagcaggggcttttaataatgagaatgattcaacacatgggcttcagtcagtcatctttcccagctttccctgggagtctcatgaaccaatgttatggaggtctctgtggggactcaataatttgagtttcccccaaccgagatttagagtgctactggctcttctgaacacctaatttgccaagaagaatgacccctcctgaacccttcacattgtatcacacatcagggctcagactaacatctgatgtcaggtgattctagtgtcactgggtgcaccagactcagattttggacacaaaatttcctgaagcagccaacagttgtgcctcttttgaatggcagctccttgcttgctgtaggaaactgataggggctgagtatctcagagctagagcaccaggcaggacgctgcgaccttaactaaccattctcactttggtacctacaaacacaatcaataaaactggacaggcccaacagatccaaattattaaatggaactggtacagtcagaattcgccctaacccagttcccacaggatccatgtgcaaatggatgaatgcccataaacaaatagcaagcttcctagaagggaacaaatgacccataggggacaattttgtttttcctttggccacaatgagccaacgattcagagacatgcctatgtcagtatggcatggggccctgatgattgtacaaaatacatgccagtgggtccactgggtgaggccaccatccagccaggggatggcatcttttgactgacactgaacatggccattctgcccaatgggacaaactacttgaaatgatagtagccatgcaggctgcccccaacactttattttgctccatttccactaaatcatgggccattgccaacagcccagctttctggtcaggaaaatagcaactgagtgactgaactattaaaggaactcatgagtggagaaaaggactatggcaatagtttgctttctggacagctaaatatatgtcactctattagaggctggggctaccatggccacccttcagaggaatttatgtcatgtttttggatattccatgagacttcactctgaccaagaaacagcctcactgaccaatcaacataacaatgggcacactctcatggaaaccaatggactttccatgcaattaccaacacccaacactggctgctgtacctggataaacacctcagatatcctagaaatacaagtaggggtgatcataaagcaggctcactggctgcagacaataggacatcaaaagatccccctttcacctcttaacatcttagtcactgcttggggagttttatcctcctaccagtggtactagcttttcatggcccagtgaaatgtactctcactatggct

SEQ ID NO: 135 - DNA, 1727 bp, Artificial Sequence
  Description of Artificial Sequence: Synthetic polynucleotide
gttctgcagcattaggcgtgattcctgatcagcttttctcttctttctcttcttgtctgggtatctaatgtaatcaaaaggagcaagaaaaaagaaagaaaacattttctacccccactcgtcaccccactgtggctgcatggtctgactccagaatctttgttttgtaaaagtgaatattagtgaggctcataacaacaaacctaaaaatggaaatcctccaatagtaaaagtagcaacagtcaaatacttctctgtctgtgaagaaagccagcttatgaagaactgaatgtccattacagctcttcgagtagacgcggcccttcaacatatttctcttttattacagatgccagcttcagaaatgaaaatcgctgtgtgagaaaaactgagctagcttctaatgcaatttttattcaggtttgcacatactaaatcactgtttaaggggaaaggtcaaataatagaatgattttatcccataattttttgagaagaatatctttttattagaatgcttacatgtccggtgccaatttcttctagaaatctgttttttaaaagaaatgtgcttcactttgacctaatacataaattgcctattttgtgtgccctggcatgctggtagcagctgtttaaattccctttcttgctttcctttagtcagcagatttacagctctgttctagttatgagggctcttaccgtagctgagggagagtacagttgcccatgaacgcaggtctacaggacagggtgcatgggtgccactccattcaccagagactgttctctcttgttgcttagaaccctgctctgcagctgtcagacctttctacctcctgcagctactgaagagtggatgcatgcacacaatgctgccttcctcctgctggggacactgcacatctgataacagcacattttcatggtagcacacccattcaagcaagaactgattttgtgcagatgggatgatggttatgatagaagctgctaataattttgaacacttacgacttctttacctctggctgtgatcccaggaggtaatcataatcattttactgatagggaactgaagctgaaggggattatgtaacttattggagtttattcaactagtaggtagtacaggtgagactcaaatccagtttctgtttgactctagagctaagatggtacaaatatttgcatcataatttcatctggcaattcctcatatctgaaaactttatactttcctaattctgcttattaaaaatatatagagatatgaatggctttggcaaaatccaaaggagaacaatatacattggtggaaaaacaaacagaaacctttccaagaacgaaattctaataccacatatatttaataactgctttaatgcataaatgagaatgctttataattagcactacatttactgatatatagacaagtgttgctaaaatgcttgaaactatttagtcacagagtttaaaaatgcttcctgactgtctgctttcattattcgttagcattctctttattaatctcgcataagtagttttaatccaaaatttatttgaataatcacaaattccatattaggaattccacatgtggttttgttgccctgatcatgaatggtgctaaatttgactaagggtttcagaaagtgtaatgaagttggggaatgcaatggagacaaatggcatccatgtgcactggtgtcctttcagcg

SEQ ID NO: 136 - DNA, 1724 bp, Artificial Sequence
  Description of Artificial Sequence: Synthetic polynucleotide
gctgcacacagagcgccagttactttttatataacatggtttttggtctcttcatcatcatgtccactctccccaaatacatcatctatctctttccctcttaaattgggctacccaaaactaaatgcaaagatgaggtttaaccagcacaggcagcatgcttatccccaattctgttctaacgctatgtttctcttacccaagtgaacatggtatacatttaggtacacctgccagatttcgaaggtggaagtgagtttccctgaattctgccactgccaccaacaagtacagctgtgaatactttgggatttttctgcagcagcacttggtattgcctaatcactagctttgtgggtgattaaagacagttgcaaagacatcagaagtagcttttgggttcctactgtgaagttggtaattccagtagtagcttactgattcctcttcttcctgactgtggcagaagtagaaactttcctggcagactaaatccatggtgttcctctaagattcattcctggaggccccacctagagtctgctcctccagcacatccgacaatgttgtaagtgcagatggtccccaacttaagatggttcaacgtcaggatcgtgcgaaagtgatacacgttcagtatcctcctctacttacgatgggtttatcataagttgagaagcatctgtacttaattccttgtattgaatcccttgctgcttaaaatggatagagtactctctgtttcctgcaactgtatggtgaacattttgaacaatgagtaggatttcacaagacagaaaagattatagcaattaaaagatattgctttatattcacaaatatgtaatatccatggggctggagaatggatggacagatgtattaaatttgtggatggatggatgggcatgggaaacactgccttcctgtctctatatgcttatcccataaagtcacaggttggcaatactggctggcatctatattactgatcaaaatatgtagtttggctacagtgataaatattcccatattgatcaggactctgggttaccaggcacaaaaacacaccttaaaatgattcaggcaaaagagagggattagtaatagcccaacaactgaaaaggcaggtgtggatatgactttaggaaccactaagccaaggatcaaaggctctaaggaatctctctcttcatctgtcatctctacttctctccaaatactagatatcgtctcccaaaccatcttacctaacagaatggggcatgactgtcagctactccagatttagatcccaaatgctccagaaccagagatgaaaataaaggctgtcttctcccaactgaaatttgaaaaacccaagagaaaaactcagatcaccctggtttggaccctatgctcatccttggtccattgctgtggcctggaagtgaggcactaagattggcccagcctggaccacataatcattcctgtagccaggggagccacatcaattggcagaagaataggcatggggcagacatagcaatgctcgccccctaggcctgacatgatctgaatgactcaccaattgcagctgttactcttttagatgttaactcttctcagaggatttaaaaccgctgacaatactggtacactgagaagctggtttcagtgttactactttgacgcacatgtttcttaaatatttcatccatggagggcgctctgtgtgcagc

SEQ ID NO: 137 - DNA, 1722 bp, Artificial Sequence
  Description of Artificial Sequence: Synthetic polynucleotide
taaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgaattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaa

SEQ ID NO: 138 - DNA, 1719 bp, Artificial Sequence
  Description of Artificial Sequence: Synthetic polynucleotide
acccattatcccactccagagagtatattctcacagaccattgtttaaaagcaaaatacctgatttcccatacctcaaagtaagcttattgcccatcctatgcatacctccacatataaactcaaagaaactatgtgaattagaatagaacacattgcagtccacacaatgtttaaataaatggcatcatacccaatttttccccatatgggtacgagagacataagctgaattatgaacagacagtcacggagcaatgctcaaagtcattaaataattatattttgccattttcccgctttaatgctttctctgctatatctattaatttttcagaccttggggcagggacaaagtgagaaaggaatatcagtggggtagatccagagttcatttctttgcttactttattctttttcctaatccagatacttaaagagccttagcttattagaagaaaacaaacgctaatcttgaatacttcatttctttgacctaatgagtggcagattcataaaggcgttatcacaatttggcattattatagccaattaaagtgtatgctcttgcaaatatcatggttttggtttttgctttcttatatttaccggtgccagcatttctcaattgggataagccaacaaatcaattattcaaaaggtatgaaaaagggttcattgtttcatatctagtggctgagtttaagatttggtaaatactgagccagaattttagtgtgtggttttattacatgacaatactcatttttaagttgagatctctttagcttgaccctaagtgtttttatgttttatatactttcctgaacagtttttcttctcaccctgtacaccctggtttatacctgctttcaccttcctggactgactattgaatctcaagcttacttttttgtaagattcaatagtgagcatttacttttttccttttacaacttctaaccatttgaacatcttttctgtcagtcctcctagtacaggagtctaagggctcagctattcctttgtccaattctgacaccctgtatgtagacatatgatttagatgcagccatttcatggtttcagctaggactttgaaacttggactgatgcaaatttgaagggaaatggtgaaattaatcactgtggttatatttttgagagtccagttctgatggtagaatcctagccagaatgttcctgggacattgacttgattatttttctgcccaaattctgaccctggcttcctactcttgccacagatctgtaagccctctgatgtcattccaaaaaattcatgatttctcttgaatgcagctaaatactctaacagtgccacaattatgtaatttactgcaatgatactataaaactgcatgtatcctcatccatatgttgtaattagttcatcaaccatttatacattggtagagtgatttagtttttactgtgcattctattgctaagctcaataagttcgttaattcttttaaaaatctcccaattatattctttagaaattggctatttaattttctaaattgaaagcatgtatttgtaactgcgctctgtgtgcagcagaaaggaattgaatgtattcgagacgaatagaacagaaatgaatggaaaggcatcaaatggaatggacacgaagggacgggacttgaatggactcaagggttatgggagcgtgggggggggagtcgtagggggt

SEQ ID NO: 139 - DNA, 1719 bp, Artificial Sequence
  Description of Artificial Sequence: Synthetic polynucleotide
gagtctcttcatttattgtactggggtgggaggaagcctgcatacaagcacagacatatggtttttatttaatgagctaatgaaaagaatgcatttcaagacatagcacatattacggtgactcaaattgcttatgctatttcatgtttttataagttaccatctaatttgtcattacaattcaaagtaacttcattttcccctgtggagtactgaaaattactgtaacttataattttatggtaattatagtgagaactcccataattagtgtagcaagttcaccgttctatttatttttccaaatgagtcacacccctggtaggggaaacttgctgtgtaggtttaaagctccaggtgctatctataggtgcatggtatctcatcatcataacctttcttcctatttcccctctgaaatattctccccgaccaacttgaggaaagatctaagtttaaaatagaataatactgaaaatttagtctgcttagaacatatgccatatttacatggaacgaaaagaagcttacggcacccaaggcccttgcatttatttgttctcaagtttttgtgtgtaatatatacttactcaataaactgcttccattcagagcacaagaattatccggtcgtctaccttccatccaaatgtgtggctgtagtatccaccaaagctcctcagtcatgaaataggacctctatcctcccgcttacagttttaataacagctgtggattggactttattagtgcttctagtcctctccagccccgtgttgatgccttggttcaggtgctcattatttctgctttattcaaagtctccttgaaaacaggaggacctgcagagataatcacttcattcttcgtgccccagacatacctgtacatagctttagaataacaacacctgagaacacgttggcaacaatatagagcaacagggactttcctactctgcgagtgtggacctgaattatgactggcattttggagagaagtttggcaaaactgagaaaaaaggaagatgattatatcccacagccaggatagtcaaggttttagttatattattaggagtaatactcagaaataaaaaagtgaattgcacaagaaaagatgcatacaaaagtttgttgcaatgttgtttataatatcaaaaaaataaaaataaaaaacaatccagggtccttcaacaggagaatgcataaataaattggcattttatacaaagtaattgtgaacacatgctacaagatgtaaattataaattactgtgtcaatgttggtaatctcagacacaaagtatggaacaaggaaaagtgagctgcagagaataataaaattcaaatacttctaaaataagtaatattttgaataaagtatcccaaacatttactgagcagttactatgttcctggcattgtttcaagtactttgctcttggaaaggaaaaatgtgaaattcgtgaggatatttgcttatggtgagggagtttatggtgaagaggctaggaaaatggttttgggaaggggccttagctttacttgtagtgcttattttctttctaaaggtatatctgcctgctgggcatggtggctcacacctgtaatcccaccactttgggaggccaaggtgaatggatcacctgaggtcaagagttccagaccagactgaccaacaaggtgaaactctatctctactaaaaatacaaaagtt

SEQ ID NO: 140 - DNA, 1719 bp, Artificial Sequence
  Description of Artificial Sequence: Synthetic polynucleotide
gtggcacgtgtcggtcagtcctcaggcccgccctgcccactggccccccgccggccacccgcctggccggccacctgtggtccccttcaggcagaagcagaggtaggcgttgtcgcggtcctggcaggtgcccccgtggcggcagggctggctggagcactcgttgatgttggtctcgcagtggtggcccgtgtagcctgggcggcagaggcaggtgaaggtggcgacgccgtccttgcaggagccgtagtggcaggggtcggggtcgcactcatcgatgtccacctcgcagtgcgtccccgtgtaccctggaccgcgggaggggcgggcacaggaagacttaggactggcggcccccgggacacccatgaccagacctggggtcacctgtgccaacctgaggagggctccgagcgtggcattcccacctactcaggattgctgtgctctcggcctctggaccaggtggcccagaccaaggtgtccatgaccttgtcagtttcactgccctgagtgccctgtcccgtccccagtccctccccgctggtgggcgccggcccgcaccttccgtgcacacacaggtgtaagtgttgggtccgtccaggcacttggcaccattcttgcagggggtgctggcacactcgtccacatcgtactggcacagatgcccagtgaagcctggggccggggaggggaggggagggagtcatgtgcaacagcgctatggcccttcagggacccctggccagaccccagcagtgagcgcctggctgggctccccagggcacactcagcctgagctcagccagccccagctctccctgcctcccgctgcccgctccccggatcaaagcccctcccccagcaccacacgccctcgctcccacagaaggggcctttttcccaaaccgactgggttgctatggctacagtggagccgggctgagaatggggctcccctcgctccagtgtctgggacgggtaatctatgtcttgggagcctaggcttgggctggcaacgcctccctgggctctgcgccccggcccccagctctgggacagatggaaacacctttcacccaggcccctgagagttcctccaagtccgccccgggcagccatcatctccattgcaggccaacctgccccacgtggttctctgcatacccttgtcgctggcgtgccgttgggcaggggacatggcaggacagggcaggctggcctccctcccagcctcgagccctcagaaagccaggctggagcctcctccctgtctgggcactgcagctcctggtatacccttctctccaggcagaaggggctgcacccagatcaaggaggatctcctggccctgggctccaccgcgacccctgggcaagctcccactccccactgggccctgcccttccttcggggaagtctgaaaacactcccatccactcatgaggcaaaaccctcgctctcctgggaatctgaacacaaccaatggccaggcccccctcaggaggccggggtgcagacggcccaggggcaggggacacaacctacggccaggcacccctcaggaggccggggtgcagacggcccaggggcaggggacacaatccacagccaggcccccctcaggaggccggggtgcagacggcccaggagcaggggacacaacccacggccctcacccctcaggaggccggggtgcggacggcccgagggcaggg

SEQ ID NO: 141 - DNA, 1716 bp, Artificial Sequence
  Description of Artificial Sequence: Synthetic polynucleotide
aaaaaaaaatcaactattttcctttggtccaaaagttttgccagaatttgtattattgctgctacaaaattgattcaaacatataatcattttgacacttcgttactaattaatttggtattttttcaatgatgaaaatcttagtaagtttactaacttttcacataaatggcctagaaatagtacaatctgaaataacattccttttctttctctgcaggttttatgcccaggtctatcaaatatcatgtgtgagtcaccgttccctctggtgccatacttgatattgttttgttctcctaacaatttcaaagtataagcaagaggtatcagcctcttgtcacataggccaaagtacaaacagtacttagcttctctaagcagtatgtatgataatttatacaatatccctggtacgtttcagtcaatattctgttattagtgtttactatatacttttctaaatattttctagtgccttcaacttgtctttgttccaaaccccagtaggatcaggcaacaagtcaattttctgcatatttgatgaatacattttaaacaattatagaaagtgaaacatatttcataccattcaacctgacattcttcctatatcagtttgattatatggatgcaaccactctctctcccttcttttgtttttctcttaatgaaaactagaatcaaacatggtgcagattttctagaatgtctaatgcaggaacgtacagaattctgagatgagaggtgtattcctttccaaatcaatgagcaaaactaaagagagtatgcctgcatcatttctcacaggacacaataggggctgatactaactggaaatctggtaacaggtttttggtgttcacattttagtgttcattataaagcaactgctgacacaaatcaagtccacttactgcttggtcaataggtcatcaggaaaaaatcagctctgaagctctgttggctgattgaacttctgtaggtcctgctaccaatcccgaaagtaaccattggtgatcacttaaagttcggggaagatgaattttgaaattggtcctattcaagtgcagaagaaccaaagaaagagctaaacagaagaaacctgtgaacctgtgtgaaattgaaaatccctggatgggaactgcacagtgctaatcgttatcttcggccaatcaattgactctgtgtttactagctatttgtcttatttctgaattcagtatatcttcagcgttccccatttgtcatataattgttattgttagttttggacaaatagtatttgctatttttgaggatgcagcaaaattctgatctttcaaatctggagtagaggcaaagttagagactgcacaaggccctagacaccattttggtaacatttgcttttgttcttgactcaagctatcttcaagaaggcatttacttctcagaactcatgtactgacatggagtattgcaataactccaacaatcaataagcctgcttctaaggtgggctgagtgcttaagcacttcacagtgatggggttaacctacccctccaagtgcattttaagactaagttttcatgaaaatattcattttcaaaaagacacttataatccaaccaaacatgatgagattttttccattaaacagacataaaaatatatatctgaaataatccactttatataatgaattgtacaaaattgttttaacacaattttt

SEQ ID NO: 142 - DNA, 1714 bp, Artificial Sequence
  Description of Artificial Sequence: Synthetic polynucleotide
gctgcacacagagcgctttaaaccaccatatctgagaacatgatgtcaagttccttttagtccctgcaatgttttacctatagagagagctctcaataaatactgaccaattgtaagtttgaggatctgtttcagagtggggtaggggaatgagagagtctagccttagttttaaaaacatttttcagtacctacttgacctggctgtcacctgccatttctgtatgcctttgaaattcaggtgaactgggttggagtcagcagattttacatcctggttaataccactttctacctcaagttttcttatcctgccaccacacaggttctgtttctgagctgtcctgatgtaaaatttaccctctgcaagtgtccgcaagacacctaacctcacagtatgatgtttttctagtacttctcttgaagatgttgggattacattgcatggcttacgatattttgttgatactttccccttctactgctccttatccccacacacctaaaaccacacacacgctctgagtcttctaaaagtctaagcttcagcccccactgggataccctcttcttgcagcttccccatgaagcatcatccgttcttctctaattttcttccattggaaatgtggtgaataaaattctctacatttttttacactaataggtgctttgtgattttatgtacagtttcacgtaatgcttgcaattagatgttagtgttctcattttatgatgagagagagagagagacaagaaaaaaaaatagtcttgagtagttaggacttatccgaggccagttgtcactgaaggtactgtgttgggaagcttagctccctgcctggactctgatgatttttctattctatcctgcctccccagtccaactgaggcatgcagcagagaggaagaaaggggattctgtcttaggtagccagctctggcagtgtttctcaatggaatgctgttgacaatttgagtaggatgatttgctgcaaggaactgttctgggcattgcaggtgcctggaatccctggctcctatccactaagtgctggtagtgtcttccactcactgtggcaaccaatgaagtaacctcatgcatgtctaaagctttaaagtatgtggagaagtatagattatccctgagataggtggactaagtctttatttcgatactggggtcctcatttccatattcatagattaactggaaggaagtatgaatatagcagccactactaatgttaaaatggcaacatgaaacaaaatggtgagggaagaggagagtggcagtaggaaaactacagtctttctctccccgtacttgacacgtgggtcccatggaaggctcagattgcagtgtccttctcacccctggaattaggctgtgggtagaagccaagatagaatggaaaacaaggccaggaaggaagtggtgtcttgggaagcagcaggaaagagggaaccagcatttgttggtggggagatgactgggcaagcaggaaggacatctagatagagtctttgcttggttgcaagcaattgtgtaatcttgagcagtatcctcttgacatgcagaatgagagacttggatcaggggatggccaagagtcttggccctgtttctcagttcagggactttgaggatcagaagtactggttattttgtttactgatatttcttaatactttggttgttgtgtacagttta

SEQ ID NO: 143 - DNA, 1714 bp, Artificial Sequence
  Description of Artificial Sequence: Synthetic polynucleotide
ggtgtgaaccaccgctcccagccaaaactcacttttaaagaatagcgtcttaagcttcagggcttaaagcccaaaactttattggggagtgcaatcccagggtagaaggagtcagcccaaaaggagggagagcaaatataaggaaatgtgttgctaacttttcacaacttcagtggtgatgatatctcagtttctcgggttgtcttcagagaggccacgttgccaagagggaaaaggatgaaagaattgatctgttgacatctgtcttccattgttaaaagtttgcccagcattttgaggctaagtgctaagtgggttctgaggcatcttgcacctcaacagcaatgtgggagccccagaacggtggagggagaggtaacagggcacaggaatgaagaaagatgctctttggccatgcccgcttgtgacacggggaccagtattagctgccacagtggtgctaggtctgtagaggcagtcataccttgcaacagagacttccaggaccacgagaacttcaagtcatacctagggctgcctcagccaagaaataaggcaatgcagtgaatccagggccaatagcaagtctgcagggattggggttttcaatgaaagcttctgtaatggtacattaaaattaaattttgctgaggcatatactaaatggtgagatgtgagaccactccaatgcaggatataaactcaggtcccttgtccttccaagccttgccttttccatagttccccactggttgttatagagtgcaatactggcttcaacagtcaccatcatggcagaagaaggtgggtcatctacaagccacacttcaagtttccagtggattgggcatggaagtttaattgcatttactgcagaagcaagtgatgatgataagtttgtggtaaatgtggaccgggtgggggtcacagggtggggttgggtatgaaaagatcatggctgtattgcattcctgtccttcttttttatccactgctcatgagtgccaggcataataggattaagtagcatcttagaggtacccttggatattggggcatagctctttgcttctgtgtgtgctagaaccctcttgggagctaggtctcctgtgcctaccttctccctcttcactacaaggctacacattcgttttcagttccaacagtccaaaaccacctgctcttcacttttcccaggtttccgaggcaaaaagcaagcagctttttgaggggaatgaggtgggaatcgagggttcccccatcagcgccctgggagacattaaaggggaaatttagcctaagtaatggttgaaacctgtagctcagagaactacaaaactacagcctgggacactttgaacatctgctctagaaagattttgtggattttttagattcactttgggttttcatgggaaaactcagggaatggaagatgttaatttcttatctgggtcacttaacatctcattgcctcttcgtgtttttaactttcccaaagtgttggtttgaagttccttaaacattgatgccttgctctgctgttttggggaacttacactgtttatgaagtcatatgactgattctatttatgtttgaagtatctggttaagcagttttccctgaatctccaagcagttatcagatttggtagctgaagatcttagctttataggatatgaataactctactgtaggggatgaatagggata

SEQ ID NO: 144 - DNA, 1709 bp, Artificial Sequence
  Description of Artificial Sequence: Synthetic polynucleotide
gggctttctgtggcattgagtcttgcaaaattgtcttctagcctggagtgtgatgtgcttctactagctacattatttgtttttctatggctgtttcctttcccttggtaggatgtgtgtgattctaaaaatgccttttactgcctgttttgcctgaaggtcaccacctgggaggttttccccacttttgcaggaactgtggcaagaagaatattatgtttctattatggtacttatcatgatactgtttatcatgcttttatagttttatagtggagcacttttgcgataatgtagggcatgttgctcataactgttttactgaactgctgaaccaagagagtgaagacaggcagacagaagcaagtcactatgctatgaggccaccttgggcaaacatcttcaatagctttataatcatgtgttacttcatggctacctgttttctatatgggaagaagttcttcacatgagagtttattttgctagtgatagataaagtttctactctcttcagggacattccttaaagttgactttactgtaacaacagacatttcttcagttttcagttttattgctatttctgctagaacacctcatccaccagcttggccccataaatgatggtggtctgtcaaagcatgccctaccaggcaagtgaagactgccattcagactttgcctccagcaattacctaggattccctggaatgagaggactcagtgtcattccctcctccagaaaacagccagtcctgagcgtgcagggttgccagcctcaatttcatcacttgcttttctacttttaaatgtttgcaaacaacagcagtccatgtcacatgttttattctttttagattaatgaggtggcctgttcaagttggacgggccgcattaatctcagtgaatgcagtccttagcaccacaaaaacaaacagatgattttaactcaactggacaaagagtcttggcatagtaggtgcataattgttgctttttggcatttgactggacagcgagagttgtgattttgattctccaaaagcagactatgtgagcaccaagtatattttaggtcatttagatagtttgttgtttgaatgaatgaggataagacatccatcaatttttgatactgcaccaaatctgccttatttcaaaaggaactaactaaacactccatcacagatgccctgacaaagatgcatggatgactatattaacgagactgtgtcagaatgaataataatcaatggctgtcctgagaatccaacataaatttccttatctaaaatagtggtttgtttaaatgatgaagcaaaggtggcattggagctgttggctcactgtcccttttattctgttaactgcagaagcactgaatctgacgccctaccttgtggggtaatggtgtgcttatctccccctcctcaaacagagtttggaacgttgctagtaacagctagcctactgctaaaataccatcaatgacaggacagaagaaatggatatttaggaaaacataaaactgaggaagtaggccaaaaaaagtactgatcgaaagcaaataaaggaaagatctataatattgggacaggcagcatctccctgcttgcatggtaattttctttagccggtaaccaatgagaacgcctgccatgggaagaaggtgtgattttgtgatttaatgatccaaggcccatttt

SEQ ID NO: 145 - DNA, 1708 bp, Artificial Sequence
  Description of Artificial Sequence: Synthetic polynucleotide
gcgctctgtgtgcagctacttcctcagccacgctgacctttgtcttcctccaacacagcaaacatgttcccataatcagcactgttcatttgctgttccttgtactgcagagtctgtcaccggatgtctgcacagtgatccctcattcagctcttatcttgactgttacttccttagaggtgacacctggccaccacagctaaggcagttcctccccacccctacccattcaccttcagtcatgccgccctgtgttatatgcttcatagcaatggtcatctcaccatgggatgctctctcattgaaacgcgtttattattatctctatcctccactaacagtaagctcaaaggaagtagagacctcaatgattttattcataattgtatgcccagcatcaggaatagcatctgattcctagtaggcactaattacagaattgctgaattaatggattgtattttctgaatccattcaactttaacattagcaaatttttaatttttcttagcacagataaatgtagaagtaaagtttagattaacctctgtctaaactgttacaaattacaaattaagtaaagtgaactcagcttctttgtctctcagaataatttgactatgagcaaggaaaaattatcacccctggaaaagtaattttttttcttatctgttttagtgacattcatagcttcagagtcaaaacacatgacatcacccataaagtatgcttcttcagagcacataaaagctactattcttttggaaactgtccatactatactctagaattacaacccttaatgagtttttcaatagtttcatttctttctcctcatctgttcagtttaataaagcttacaactctgtcacaaaattagctttttcttaaactttgacaaacaaaatgcaaaactctctgaaaggtttctctatgatttagtggaagagtagtgttgcctattaccactggggccacagtaattcaaatgatcttactgctatacatgctcacacaaacatgcatgcatataacaccagaacaaataatttaatcatgggtaacattattttctagtttttttaggagaaaatattcataattagggtattttatcagaaaagtatgagatttaaaggataaacataatatcaaacttgttctttcaaaaaatgtgatattatgtttcccctcctaaaatgacttttagatttttatgggaacatttgctggtagaccaatcatcaaagcaaaaaataatttaaacgcaatcactattatcatgaatgtaattgttaagtgaaagaaaccaaattcttattctgttatacatctacaaggaaaaaacaaagaaggtaactatctttaaacgaatgttcctttcagcattgcttagaaaagtgaaaaactgtaagtaactacaatctagcaatagtgaaatggatcaataaactgtgtgggataatgagccacagttaaaataactggactagatagattagatatacagataaagagctcaatctgaatccgcctttgcaaaattgtaacggagaacattataacagtgaaagaaatcagacctaattgactctaccttgcttctaacccttaagctgtccttattcattcctgggcatagacggaactaagtttgggaaggaattcagttcatggtttgactctgaaaaagcgctctgtgtgcagc

SEQ ID NO: 146 - DNA, 1707 bp, Artificial Sequence
  Description of Artificial Sequence: Synthetic polynucleotide
cacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacagccaaaggcaagagaaaggcagttatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccaagcgctctgtgtgcagc

SEQ ID NO: 147 - DNA, 1701 bp, Artificial Sequence
  Description of Artificial Sequence: Synthetic polynucleotide
acatttttctacttttctatattttctacacatctatatatgatttgtgtttgtgtgtttgtgtgtgtgtatgcatgcatgtaaataaaatatacctctaagtctttgtaaccttaagacggtggggcaaaatatttttattttctgttgttgattatttaaaatttagctatattaaatgttttctgatttagtaaacatacataaggcctatttatagttgaatggcagtcttacaaaacctaagcaaccttggtttactctatctgtgggaaaagcatttttagtagaatgcttgtgcatcttcctacattcctgtaatcaaacagtatttatcatcaactatgttggtgactctcactttgacatacgctgaaccagaaatcctaggaaaaactgatgacagaaagctaaggggaaggataggaagccgggaaaccctgggaaaggagggattatattacacatgttatgggaactagtttgtatgtgcggggcacagagcatacacttagataagaagggggtcataaaaccagaaaggcaataaatagaatgttatgagcatgaactctagatgcaaactgttcaggttcaattccacctctgcttcttactacatttattaccttaagcaagtcacttaacttctccctgccgtttctgccacatctgtataatggggataacagaccctaccttagagggttgtcacactaatgaattctgagaatagtccctggtactacagttaagtgctcattagttgtccacactcatcatcgtcattactcccattactatgaagtgaagagttgtgctgctaggacgggagcagcaacttttcaacaccaatcgcttttttagatggcctcctttctagccttgttagttgcccaaattctgaaaaaaacaagaactaagactctagaaggagttctgagaggcagacgtgtgtctctgtgtgtgtttgtgtgtgtgtgtaggtgcgtgggcatgtagacgaaggaggaatcaggagtaatgccaagaatgagaatcaaatctgtataagcagttcagaaaaggagcatcatgagtcgctcttctcagtgctgccccaagggttccacagtttgctccttccatcattcacttggataacacctttcaatgtctctccatggccttcagagttaaatcaaaactattccttggaatgacttaaaacccatactacctctaaagcctcatctcttgactctctcgcaccaagctcactgagcttccagccctatcaaatttcttaattaacaaactctcacatctcagaggctttgcacatgttgctccctctgcctgaaaagtaacctctacctcctccaatagcaaactgctactcaaacttcaaaacacagctcaaggataactccagagctctttcctgatttcaagcttaatgcctctgctgtattatcccctatgtgcataacagcaccactaccaccaccaccaccaccaccctcaccaccaccaccaccaccactaccaccaccaccaccatcaccactaaaaccacgaccaccaccaacaccatcaccactaccaccaccaccaccaccaccctcaccaccaccaccaccaccactaccaccaccaccaccatcaccactaaaaccacgaccaccaccaacaccatcaccactaccaccaccaccacca

SEQ ID NO: 148 - DNA, 1696 bp, Artificial Sequence
  Description of Artificial Sequence: Synthetic polynucleotide
gcctgataatgtttaatttataaattaggcattgtaagagattaacaactactaacaaaatagaacaattataacaatatgcctgcaccgtaactcttgcactttggtgccattattaagtaaaataagggtgacacttaaacacaggcactgtgatcctgttacaatcgatctgataactgagatagctactatttgtgatggtacaagatttcatcaggctgctcagaatgacctgcaactcaaaatgtatgaattgcttatttcaggaattctccatttcacattttttttttttttaccacagttggttgtgggttagtgtaactgctaaaagcaaaacatcagataaggcgagactgctgtaagactcttcctaagtctgaattggtctagggactgaagcaagttggaagttgcagctcaaaggagctacaatccagtgagaagaaaagacccatactgatgaatcacagcaaaaaaagtggcaaggcacatacctaacattagggtaaacagaggtggaggaagtggtggggtgtttagaatacatggggaagatggtgcaggctatggggaagaatagtagggatgaggcagtcattttaatttgggagaagtggagtttgaaagaggagtttttatttaagtatagattctatgagcatacatgaaagaatctggattcgagaaggaagtggtaatactgccattgaaggattgttaccttggcactgatgcgtagggactctaggatctgggacgggatggaaccaaagacaagagattttgggaatgaggtcaggaaaacatctacatcagggtgcttgttaaaaatgtggatttctgggcttcaccctatatctaataagctagtatctgtttcagtgttttgctatgaagtcagcaattttaccgtgagccccaggtgattcttaacacatgattgttcccagctctgcctgttagaatcaccaagggagcttcgaaaaaatcctgatgcgtggctttaccactaggagcaattaaatcaacacctctggagatgaattctgggcttcagtgtttgtttgttttttaatgttccctggcgattggaacattcagttgaggttgaaatctactgagccagaagtttctcacagtgagccaggcatggggtcttgatcatgtgcctggagttatggtcatagaaatggagaagagatgtgcataaaaaatatttggaaaaaaatgtccaaagcaattccatctttagttcataaaatattattaattgatatatcatttagaaacaaaaactctttttttaaaaaaaacacttcagtgttggattttaaaaataaaatggcttaccttggcatgagcaaagtatcaactagcattctttaaatattaataaatagaatgtggttgcatgtatttttgtccctaattatcttttgcttttatttcatgtgaatttcagcacctgagctgcagtgtaactttgaaactggaatctgtaactgggaacaagatgcaaaagatgactttgattggaccaggaaccagggtccaactccaacacttaacacagggccaatgaaagataacactctgggcacagctaaaggacactatctctacatagaatcttcagagccacaggcttttcaagacagtgctgccttactcagcccaatccttaatgcca

SEQ ID NO: 149 - DNA, 1692 bp, Artificial Sequence
  Description of Artificial Sequence: Synthetic polynucleotide
cggcctccctctgatcagccccttctttctgatcagatgcattattgacgaggcagcctcctccacctgcctctcatcagagcagctcgtttcccaccgtggtaatttatacttgtgattttggccttgatcaataaaggcaacggagaagacgcacccgttcatttcctacaggaggggcggaaacacacaggcctctgtgcagagctttcctgggctcttctgaaggcaagcaaacccatcaaagggaagatctgcacgctgaaaggtcagcagttcccttttccccatgggatttgtgttagcaagtttgcgagtggaagatgcatttggaactgccagtcccttacagccctcacatgggaggtgcaatgttcatcctgtcactattttaaaactcgtctcagggttgggagtaactgaaaccgttttgggcttaattttgcatgaggacgtagcagagcatgacagaagggaaaaagagaaaatgctggcaaaggagaaatggccctaagagggaagccggatccctagctgggtcggagtagatgagcggggaatgaggggctggaggatgcagctccgagcgtgcaggggtggtgtgctctcgggagggagctgctgcggagctactaaggagggaggctgaggggtgggagaaagcccagggctgtaatcgtagcccctggagcctgatttaaaagactggaggaggcaaaacctttcctgggtgacatccatccagggcatgaccctgcggcctccgtgtctgctgtgggcgaggctgtccctgcagccagccctgcccccatcccttcccttctagggatgttggagtgtggggcagcccagcttctgcccacagcacagatgaggaactgaggatgcaggggcccgtgggggacggcacacggtcagcccagaattaggacctaaggttggccctacgggttcctgcagcacagacgtgcagcatgtgcacccacatgtacacacaatcaggcatagccacagagaatcacaccctcccacgcacacccacacccacgcaccctcccacaggcacacgcgcaccctcacactcatggtctcgccctcccacaggcacacctacactcacccacgcctacaggcacacaagcacacactcctttccccccgcaatccctgcacacccgtgggcacctatgctctcgtgtggtctggatctgccctctgtgtgcacagcctgtgcctggcccagcgtgagtgactcgtggatgctctgcaggtgagacctgaggtgagtgtcctggcaccgcccgggcctggctatcgggaagctccgcccagacggccgcctcctccctggcgcgggcctcttccctaggaggagctcgttagcttgtttttccatcggtattctttgtcctcagtcacccagacctggggctgggcactgccaggggcaaatgtgccatgtggagaggccaagcgggggacaggggcggcttgtccgccaggtggcaccgaggcggctgcgtgtggggcagtgttcccactctcgtcaccagcccgcacttcccgctgcctctgagtattctgtgggggctgccccggctgcagccccaggtgtagcctgctggaaatctcacggtgtccaggccccatccctaaccggcccggggcatccctgatttcgtgctcaccgag

SEQ ID NO: 150 - DNA, 1686 bp, Artificial Sequence
  Description of Artificial Sequence: Synthetic polynucleotide
gctgcacacagagcgccactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggtaagaaaggtacccaaggcttatgttgagggcggcatgcatgtggagagcttgtggatatggggtcaaagaaatactagcagtttctgggtactcaggagggggttatgtctgaatgctggatgtcacctgctcctagaaatattttagtctcctggttgtccctgctggagctgtccacagccaggtgacgatgaacacctcctggctaggatggctagcccagtctcaggaatagtggctttgttacactgtatctgctcctatgtctttactactgctgtccattcttttgttcatttatttactcattctgtaaattgtctatgtcctttaaaagggctaaaagacagcaatgctatttactgacttagaaggtaaatacattccaaggttcttcaagttctttacagctgggcttgttccaaggctggcatttgtgtagtggattcctccatcagctggtgtggttgttcagatgaccttcaagatcccacccaaccttgagtgttaaacttctgtgattgagcaaaacagatataaaagctagaattacactctctagcccctaagcaccttgagtgcatttatttggaagaagaaatcgtactggtttctctaatggaggggcttctttgggagtgtaatgttgccagttgtgaaaaagctgagacctgtatgcttggggaggttctggacagcagaaaggaaccaggtgggatggaagcagccttttgggagaaggaaatgttagtaaaaagaggagaatgtggactggtgggtgagaagttgaaaacagaattagtagaaccatggacagggaagtgagctcaaatcaccttgacctccacggaaccaggattcaggcaggctagagatgctgcagtgagtgtgggggtggggtgggggtggcctggaactggtgtacgtgagcagcgacacaagcccagtggggacactgatgtccgagcactttacgtatgcaatctcttttacataggcttctctgtgtaccccattcacccagacccactttacaattagggacctcatcccactctctccccttccccaaatctgccaatccagccacttagagggtcaaagtgtgcagctcttttttttttgacatcttcctaaccagaggtggaagttccctctaattactgtcaatcacctggaacaattcctcctttggtttccagtgacaaattaaatgaaatgatatagtgggcttatcacaggggatgcaggtttgaggcatcttgctgggaatacatcctctagagtcactgcatcttatttgcacattcttctgggggttcccgggtggctctccttggatctctaaatgatgcaatgttagcatgcttggattcctattctcactaatggagaaaaaaaaatctcctttttaaaaaatgcacttggttaaaaggtgaaacagatgatagctttggaatttgcaactatgatattggttggctggatgagagcgctctgtgtgcagc

SEQ ID NO: 151 - DNA, 1685 bp, Artificial Sequence
  Description of Artificial Sequence: Synthetic polynucleotide
ctgcctgcttgatagagcaggaggcctgggtctggactgcggtttgggtgactgcagcagcacccggggagctcctactccacctcagaaggggcggggctcccaccagctccatggagtgtgcagccccagccgtgcctcctggctgcagcctacagcagggaagatggcagcagctgctgccatcaataggattttaggtgaccatgcaggctgagcttctcatcatgaactttgtgttatgttagtcataaggttgggtatacactgcagaaatcgatcatcaagtggaaatgctataaaagcatctgagctcaaggagatttcagatacaagtaagttatattcctttgatataacacctcctacattaactcctctccctcaattcaggcctgtggcctcatggagagttccactagcccaactgccttaagaataaagaactagagactggtttacagatgggtctgcatcatatattgaccacacagaagtagaaagctgcagcataagactccattaagggatgatctttggcagggtgggagggggaatagtgaaggaaaattgttcaagtgggcaaaattttgaccagtatgtttggttgcccagtttgccatactaagagatagctagaattaaatatctacatgactcatgagcagttgttaacagtttgtctggatggtgagggacttaaaaggaaccagacctaatgattggtgacaaagaactctgaagaaaaggtatgtggaaggaactctcagagccagcacagagggtgaagatatttttgtcttacataaatgctcaccaaatcagacatccactaccaaagaagctcccaataaccaagtggacaaaatggtgtaccgtgttggtcagtcagctatgttcctcagccaccccattgattgctcaatgggacccatgaatacagtggccatggtgggagagatggaggctattcatgagctcaacaatatggatatccccaatgaactggacactgctcctgatgggttcctaatctactcacagaagacaccaacactgaggctcatagggaaccattccccaggggaccagccagccacctgatggcaggttgattactctggacttcttccaccattgagagataagagatttttcctcactagaatagacacatctactggataaggatttagctttcctgccttaaatgtttctgtcagcaccactctctgcagactcatgaaatgtctcattaactgtgcctgatcaaggagcaaattttacagtaaaggaagtatagcaataggcccatgcccaaggaatcttaccacaatacctcatcacccaggaacagctggcttaattgaaagctagactggctcactgaaaagtcagctatgctgtcaattgtgagataacaccctgaaagaatgttgtctgtcttacaagctgcagtatatgctttgaaccagagatccctatatggtgccatctcccatacaaccaaaacatacgtgtctggcaatcaaaggtgaaagtgagagaaacacactattatacgtagtaaaacactagcagaattttttgcttcccattcagcaacctagagttcttctggtttggaggtcttggttcccaagagggaattaaaggatataacaatggttccattgatttggaag

SEQ ID NO: 152 - DNA, 1685 bp, Artificial Sequence
  Description of Artificial Sequence: Synthetic polynucleotide
gctgcacacagagcgcccaaatcattttccttcagaattgtgaaggtgcttcacagacatgatcataatcatagtgacaacaacaatgacaatagcactaataaaagcaaacactgattgagatcttcctatgcactagtacgtcttttatatgtattatttttcacaacatacacaatatatagggatcatattgtgatgatccctatatctcacagctgagaaaatggaggcataacagtaaaattgtttcaccaagatcattatacaaccagtaagagacagtgtctggaaaatctttcttagtgaccaaacaaagtcctgaaatagtactgaaaagatctcagctttcccagactagtaaatcaggggcctaggagtcaaatggacactaattagtgtgaaaactgataccaaaatttaggtctgttatagaatcagttttctttccactcttccatgctttctctttttgtctcttcatgtttaccaggttgctgccacatttacaagaacagaaagccaacttaaaattaaccaacacaataaactaaatcttgttacaagtgtttggttttataaaagagttaaatctttaaaatatctttattaaattattaaactcatcaatcatctaacaatgaaaataattgtagagttaaaataatacaagccagagctgaaagattcaggcctacattgtcaaggtgcattttagagaaaaggtttttctttccttttcaatttttcttcctttctctatttttctttaaatacttcctcacaaacacaagatcaagtatcaagaaaagtaattcttgcctgactcctgcagctttttagtaaaaatggaaattacaatgtgaactatctttcatcaaatggcatttataagttgggccatgacttttcatcttctatttgctaatcactattggagatacaaagggcatgccttagagacatattctaaataagatactttttcctatacatttaagccatttataatctcttaaatttcttcattgtacagctcactttattgaaccaattaccaattttctgcacgccaaagtgcaaaaaattccagaatctatgcattataggatacatctaggcataattcctcaattaatcatttctgataagcagtacaattcagtgttaaacttatgttattttcatgaaaatctgctgagaggtactactaaatgatgtaattcattattggaagaaaaaaaaacccttatcatatgccattcagccatataatttaacaaatgataagtacctgtatcatgctaggcatcagccctacacgattttcttccaaaaaatttaacatataatgtattgttttaaaactaaagtacttaaactcttaaatttgtaaatgtgtttttaccacttacatttacattttagtattataataattttacatacaagattgtaaagatgatatttaaccttgcaattaaactgtatctcacaagaagaatgagttcaataaatatcatgcaaggaaagacacagttcttcgcttctgtttttgaaaattactaaatattataataaaccatagccatggatatcacaataaaagaaacacatacaaatgataaaaactctgtgaaatacggttgatgaccagagagctaacagaacacagtaaaacagtg

SEQ ID NO: 153 - DNA, 1685 bp, Artificial Sequence
  Description of Artificial Sequence: Synthetic polynucleotide
tcagaatcagagattctctgaggatgagagcccacgatgtctgagaacacggagaaagcgagtaccctgcccagcctagcctttcaagtagcattggctatgtgttaggaggtaattaaagtttgtctgtgataagcagctgggaaaaggctgaagccaacgataagcagctaaggagctacaaaaaaatgaccaagaacaatgctgtcagcagagggaagccagcgtttagattagcacccttgaagagtgtagcagggtagaaaggatagcagatgaattcaacagtccaggtactattctagcctctggcagccatttctagggtgactcatctatgacagtacaacttctcatgcctcaatttccatatctgcaaaacaagaggactgactcatatgcccccttcagtacccaaagcctcatcaagcttcatcatgctctgaattcataaaacctggacggtgaatgtaacatctttttccaggtgctttctcctttagaaacttacagcacccatcattaattagaaatttaattcatagctcccatttggattagaattatattttggtaaaaaaaatgtattgttgatttattttctagtctcagttttccaaagctaagaaaataagtgctgctaatgccttgcctccaccatctgggctttctggaaaaatgccaattatgtgttatgtgaaatccccccacccccactgcaattagaaatttcctgcattctgttattcaaactgtatctccctaactgccacttaccacccaaagttgtacagcgttactgtcaaaggtgttttcagctttttgccttggaaaatgtgttcacggtgtctgtactgatacacaagttctgcccatagggacaacaataatcaaaagaagtgagagaataaattatgcccatactaatgtggaaaacatagccttgtgattatttctattagctattaaataaaatgtatgtgaccaaaatgtccctttgaactctccaacttacaggtactaggaagtctaacattttgttcctaagttgggtcaattgttcctacttgttcacttgcaggaccccagcgctttacagttgtagctgtcattgggaggagcatgtcttatagacaaggctggccctggccttgcgggctcaccagcacctctgctgccctcaccacccatcccttccaatgtctgctatgctcaccacattgctgcagcgccactaaagctgggcaagcggtagccctgacttaggctgcagtacctcttggggtgtatttgctttccaccattactgatatagctgcatcattacctatcttttgatttccgctgtccccttccttatgtgaaaagctaatgccctccgtcttgtggcctattcttagaaggtatcctgtgacagagttgggtggcttcttggtaatccatagctttttattttgccagccagtcttgtattcattttttaggactgctgtaacaaattaccacaaaccggtggcccaaaaccccggaaatttattgtctcacagttctgaggccaaaagtccaaactcaaggcgtcggcaggactggcttcctctgcagggtgcagggagagtccgttccacgtctggctcctgtcttctggaggctgccgccatccttggcgttccttagctcataggcgc

SEQ ID NO: 154 - DNA, 1684 bp, Artificial Sequence
  Description of Artificial Sequence: Synthetic polynucleotide
gagtatttgtggacctaatttcaagattattcagaattgtggtgacataagaaaaacatgaaaaactgaacctaacccacagtcctaatactcatttaaatggataatgttgactttatttcctatcatacattagtgaggccaaaaggttacagaatttgttggttaaaattcccccaagactcatttttcctctagaggaggtgctaatgagcagtgaaatagatcaaaactagtgagaaccatcgtcggagaatatgaggtaaggaaagagcctggacagtttgtatttcagacttttagttattgaacaattggcctcatagctgtgtgttcataggatgcacccagatttgagggggtgaaagtgtgaggggaggctgagtagcagaggcctgccagtgaggaaacacttcacctagcctaggagacatgtgaggtggttccttgcacccaagagatcctgcttccagaagagtgatgactgtgcctgaacccagccaaggattcaggtgtggagagttcctcactatagctaagccagatggtccacttttattttggtgaaggccaacctgaagcaaaggcacttttcttccaccattaaaaaaaacaacaaagcaaaaacagagacaaaaaagcttgtgatgtggagctctgccaagctagggctggaaaaaaaagtcccttgctttccttccaaggcagtatgtaaatgctgttttgtttgtgcagccaccggggatggtttagagtgcctcactaaagtccatggctgctatagaatctgatttttatgattatgaatatcctataagctaaccatctaggtctagttgtcacctccctgcacaatcatctttggttgaagatattgaattatactgcattgctatgaaagccaaatatcttcagaaagtgatcaccttaatctgtttatagaagctcgagcatgtgtttatgtgtagctctttccctaaaggacaggactctgatctttctgactttttctagagttcaggtgtggcaggcattaactgagacattaactcttcacccaaggaaggtttcttatagcttaacctaaggagttttctgcttagctagagaatttggaagaccatttttcatttcttggccaggttgtgctatttacaaaaatgaggccatgtaattagggccccggtgccgtgtggatccattcactggtacataagagagactacagtgttttcatgggttagtggctgactgtgccctctctgtttcctttaatggtgaatatgtcactgctgagaaggatggcaaccaagtcctgacaggcagattttcagaacaaagtgttagtgagtgaagaaaggtctgtgcaagccaggcgaggtttgtcactgagttctaaggaacagttctttaaaaaaaacaagcaacttcccaatctgtgtctaggatttagatccagcataagtaaaactccaggtagagcaaaacccatttagcatatgctgggaactaccatgcccgtcttccatggtgcacttacagaaatgaggaggggactgggcctcacagcttggctccagctgctgtgccccagaagaaagagccatgtgcagtggccatcccatccattcactgtggcccatcattgttggcagctaagcgaagatgctcgcgggtggttagc

SEQ ID NO: 155 - DNA, 1683 bp, Artificial Sequence
  Description of Artificial Sequence: Synthetic polynucleotide
gcgctctgtgtgcagcttactatgtatgtatatattgttttataaatagttatttttttactggtcaacgtatcataaaagttgtatctattgcaatagactttactaccattttttaaactgcataataatgcactgtatgtactacaatgcaaaccccaccctgtcctagccacagtgatgtatatttaaggcatgtctattaaacagggctgtgacaaacatccttacaaatacatctctgcaaggttgtatgatgatcccctcaggataagtggaatttcagagtcaaatggtatgcacattgacagttttgaagcacattaccagattgctattcagaaaaatgtattattttatgttcccattaactggggtttgagggtgtgcccatccctgcttgcttaccagctctggatattgccagtcactttaatgctttccagtcctattgggtgaaaagtaatctcatgggatatgcatatctttacttctccttcccctcccctttcgcctgccttgtgaattgttcatgaacttggtcattttcctgttgaggtattcgtcccttcctgattgattttcaagctctctttttgtataagaatattagctcatgtgtcacaagttgcaaataatcctcctcttcacttgacatttgtcttaaaaatttactgtgctttttgcctctagaagttttaaatttgtacttagtcaaagctatcaatacttttctttagaatttagaatttagattttgcttaggaatagcttctccaagttaatacaatatgactttttattttcttccaatacctttatggtttagatctttcaactatttcaaaaatattagtattattttcttttgaatgactagaacattatttcagtaactttataagacaaggtgaatcttaaggggatttgcatggcccaaatttgtatttaaatcagagacaaatgctcagattatccaaccaaggctgctaatattagaccaatttcttcccctaactctgtatttcatttgaaaaaaaaaaagtggttttaatctttagttaaaatgtggtttttgcctggatgtggaatttctttttttaaaaggccatgtggcgtgagtcatgtaccgagaattaactgaaggtttctttgccatcatggtcacagagaagaaaaaaaaaaatgtaaaacccagggacagcccacaaaatatccttcctgcctcctcggcccttgtacagaataaagacgttgagggtagttgaacatcttttctcaatggttccagaggctggtgtcagggaggacagagggagtggggtggcctgagactgacctgtcttcagccctccaacttcagtgcagtctgttaaaactaatacttaaaaaacaaaagaagcatttcaaatatctgacagttattattagcaacatttgaaggctgtcatatggccattgaggcaggaaccaaaaaagcaatgtcagcatgtcagcccatccacacaggaaagcttgaaattaaaattctcaagtcctagtttgattgggtgggtgggttttttaagacaaaaagcctgtccagtagagaaatagaggatatttttatacttaccaatcatttttcccagtcgacttaattgtccaaagaccatttgatgacattttggaaaaatgaatgca

SEQ ID NO: 156 - DNA, 1680 bp, Artificial Sequence
  Description of Artificial Sequence: Synthetic polynucleotide
atatattaattttcaatctatctaaattttaataaatgcctttggggatactaatctctcacttaagcatggctttagatgcatcctaaaatatttaatatgttgtgctttcattaagttcaaaatattttctaattcccattcagatgtttattttaatgcgtgtgttatatataactgtgctgcttaaaatccaaatatttgaggatttttttatatttttaaaacaatattaaagctaattgtgctatgattggagaatatactgtagataatatcaatccgttgaaattcattgacatttcttttacgacctaaaaatatgttggtacatattccatgtctacttaaacaagaaagtgcattcttcaattgttgggtatagtgttgggtaatgtctattaagtgaaataagttaataatatagtgacagtctcctatgttctacatacaaatttgagtaaataaacatttaaatttattttatattcctgattattgtttcatttaacataaattctcctctttatgacttacttttgctcaaaatatactttttctgatgttagcctatctgcatcaacttaatttggttaattttagaatggtatgtttttagtggtagacacttttaccctatttgtaaacctatagctaagttttgtttcttgtaagaagaatatcattatgctttgaatttttatacaatctctcaatctttttcttgtaatgggaacatttaatctgaataaatttaattactgacatatgtgtttatatctaccatcttactttttgttttttattagtctcatagattttatgttccttcttctgttctttgttacttcttttgtgataaatacagtattttgaacaatttcatttttcactccattaattgttggttgtatataattcttttcatggttaaactagatattccaacatgaattcttgttatagaataataaaaattagtatttttaccaacaaatttctgctaaatgcaaataacttagaaaaatttaattgtatttgatctcatcacttctatataataacaatacactgttaacctatattttaaaccccataaggtattgttttgcgtagataatatttagattgacccacatatatatatcttttttgtttcttaggctttccttcatttttatgttcctatctgactgaataatctagcagctcccccaatcctgaccgccaccttatttcttttaggacaaatcctctgctgacaaattatttcatattgtgtttgtgttgaaatactttttttaaccttcatttttggaggatattttcacttgatatagaattctaagttgagagggtttttttttagcactttaaaacatgcctttttgatgtttttccatcgtttttgttgaaaatgttctgtcagtcttgttgtttatctccaggtaaagtgtctttcgtcatccctacttcttttccatgactatctgatttttcgtttctctttgtttttgttttttagaagttttttattgtgtgcctaggtacgtagttttaaaaaaaaattcctattttttacttacctcgtttgggcttatagaacttaagtaatttgtagcataatgacttctaaaattcttgattactatctatttaatatttttgttgcttaattct

SEQ ID NO: 157 - DNA, 1678 bp, Artificial Sequence
  Description of Artificial Sequence: Synthetic polynucleotide
tgcatatgtgggtgtgtctcacacacagacacactcattaactgaaagccaacagtgggctgggcacagggacaggtgggagaagggaaagaaggcagaggtgagcgcttctctcaaggaactgatagtctcatggtggaaggggggccgccacgagtggcaagtgatttagaaatacaaaagagatcaaagcagatgtctggggaggcacaacaaatgctgtgtgagtggagaagacgatagagactagagatgccaacagcaggttgggggaagcctggctcagcggatcagccttgtggggttgttctagaggatgtgatggagggccagcagccgggactggtgcttggaaagtgggcaaggcattgcgggtctgggaaggggagaatgagacgcccagatgggcagtggtgggcaggcagatgtgagcaaagaagtagttcagggacgtctggcagtgtgccgcacacaagggcaatggtacaaggtgcaaatgaaatctgcctggaaggaaagatgtccccctcagaggggtgttcacttagaatcagagggagacagcccagcatgtcacaggcctgagataatggcatctgcaaatctggaaaggcaaagtgtggcctttgggacaagcgtcacatagctgtcctgtgacgctggccggccagcccttgtcagaggcaccagttaaggctgtttagatttcaggggtctctctgttcctcctatcttggggaccagttatgcttgtgctgtttgaatatctcccctgactctctcagtgagcaccccctatccatagagctacaccagggtgactccacacatgcatgagagcagggacaccatcacatggtgacttcttacagcacccaaaacagcgccaagtatacactaggcatctggcatcagctgagcgaatgcagaaggcattactgagttatgccaggcgtggtttgaaagtggccagagaggaaggagctgtgcaaaggtaggaggagtggggtggcacggcagggtttcatcagctagaagtggggtagctctaagcccctccacgacccttgctgtgctcctggcctcgtggggtctgatgcaagacctctactaggaagtatcagggctggctgggaaagtcgagcctcatcagttggtccctgcatttatttggcagaacagggaggccaggacattccgggaagctgggagcaaatcaatttcaggtcattcaattgcagatcaactagtctaaccctgtatcttgatgaggtcaaaattgagacccagggaggggaggtcacctggccaaggtcaaacgatcagagtcgggacatcaagatctcatttgctgaccacatgtacattgtcctgtggtcacagtaaaaagaggaatcctggggagggtttcacctccttgggtctgaacaatgccatccccacatccccctacatagtcatgacaggctctactagaatcatctcaagcctccttcttcaccctaagcctgtcatttacccataagatccagggagggaagaggcctgaacaggatggggttcagtggcccgtctgccatagacgcccctctacctggctcctgtaggctgacctttcccctcgagtctctagaagcttttcctgcctgttcacccaggggacacaagcagctggtta

SEQ ID NO: 158 - DNA, 1675 bp, Artificial Sequence
  Description of Artificial Sequence: Synthetic polynucleotide
aagaccctttcgcctccgtatcttcatcctccaccgtcccccaggtctctctctccagaaataatcctgttaggtgcgtttagtcagaatcttccttaacccagacatttcctcttagtaatttctcatccagtgatccctaaccttcttggctataaattcccacttgttcatgctgaattcggagttgagcccaatgtctgttacccactgcaaaatctcacagccgggatcccaatacctaccaccatggtcctgaataaagggttctttgcatgctttaacaagtgtcactgaatacttttttatttaacagaatctatcatacctttcttaagggcaattactcttctaagcttctcatcctatctgtttcttctcactggaaatcttcatctaagactcagtatctgatttcccattgggaccatttctctgttgtagtcgtactaggctgaggaaggcacaggaagcagcagggaacctggagccaagggtcaatagaccccacagagcccagcgaagcacgctttacaaaggacacacacggcatgtacaggtcacacaaggtcgactacgcacccctcacagtcccgcaactgcacccacgtcacacaggcaagccggtcctgtcgccgctgcgcggtctctcacgctccccgcctgtctcctagagacgggcccctcctccgcagctccagcaccctagggcctgaggaggcgggagactcgcccggcccgcctgggggcctccgcgctctgagcgcctcctgcagccccactctcaccgccacgcagggtaccacgcgggcggcgggctggggctgcagaggctcccgcagtgacctgcgccgccttcttcaggtggaaccaaaaggtcccggaaccggagccaggggtccaagttttctccgttgcctttgtaatatgtagtccaagccagaacagtcaggaccgcaggtaccggtgagaaatggagtccagaatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccagtaggaggcgagtctgagtagaaactgatccaggtagcctcggaagggatcacctgctggatgggtgtgagctcctcagggtggggcgccgaaaccctcatggctcctgaggtagagccggcctccttggtaacacatgggactgggacttttaataccacccgacaggcccagcttgtctcgtcaagcgctaagtaaatggactcacgtcctatatgagggtttgaagttccatcacattcttcaatacatgacattatgttcttcatctttggacacgaatatatttgactaaaaatttgactaaaaaatcatctgaagaaataactgctaaatagttttattatttttgttctggaataggcttcttgaagataaaataagaaatttaaaaaatttttttgatccttcatgtaatactttgtaaatcttcatagttatttagaagcatccaaaatttccaaatggtaaaaaacgaataagaaaaatttttaggtaagtaaatttggggg

SEQ ID NO: 159 - DNA, 1674 bp, Artificial Sequence
  Description of Artificial Sequence: Synthetic polynucleotide
tcttataaagcttcccaacctcattcccatgatagcccattaattcattaatccattaacccattaatccatgagtgaattaatcaagagcccttatgtcccaatcacctcttaaaggccccatctcttcatatggctacattgcagactaatgttcaacataagtttcagatgggacaaagggaaactttcaagggcatcctattcaccagtttgcaggaagcccttctgaccactcaagagcctcctgagttttccttctctgaattcttatcatattaataatctattccacaccagtaggactagtttgactcatgtccttcctaatctcttgtgaatgtaaatcaagtagttatatatctcaacttgaaattataatcttttgagcacgagagcatcttacacttctatatctgcacattgtacacatgtaataagtgtagttggatgttgacaagtattgaagaagcagataaagtcttcaaagataagaatttgtatattttttatatatctcattaagtaatggggacatttaatacatactaaatatcatagcaccacaaaaatggaggaagcacttcttagattctaacagaatccctgtcttttctgtcttgatctatatttattcttcctgtaagtaacaagcacatggttgagctatacataattctttcatttaaaggcagttgttccgaatcaagaaaaacaaaattaaataaattctgagaagggaatgagcaatagtaacaggctcaacactcttttgttaggggattaaagcattaatcatcctattatctgctattttgagctttgccaaagttgctagaggtcaataggaattagttccaattaaaaaactttagaactttccttcttatatcacctactgttttggattgaaagaagatggacgatgataacatggtcccgatagtctaattgcagtttctttccattttttgctaagaagttgtagaaaaggtcactttggattttaaaaattaagagcttcattgtcagagttatcactaatgcatataattactattttagattatcaagaaggtctaaagacagacattttattttaatattcactgttaaactgcattagtgacatttgctaataacctgaggaagttacctactgtggtggtgagttttgaattgtaaagtttagcgttttgacatggcatgccaacactacgtataatacacataaaaagtaagaattaataaatatgtcaattaaaactgttaaaaacctgaactagtccccaataacttcatcaggaaagacaaaatgtaataaacagtagcagttatttcttgacaaactgccgaatagactggtttgcagaattgctacagttcacatttagaaagttaagagagagtcctggcagattgagattggcaggtaaactaattctgaagtggtaaacatgggtaggttaattgttgaagcagcaagataatatccttcagagaatgcttccttacctgatgcattgattaaaaaataaaaattcaatgtttccagtctttagataactagtttgtaatattaagaaaatattggataattatccagcttttggtatttttcaatcattcttcaaacatctttcctgggcagtgagatgaaagctcaaggtctca

SEQ ID NO: 160 - DNA, 1673 bp, Artificial Sequence
  Description of Artificial Sequence: Synthetic polynucleotide
atatgtgccacattttcttaatccagcctatctgaatatcttaaatacctctatagaaacactgattttgctaataatggtcagtttttaggaaatgttctcaaagaggcagcttgaaaaatatcattagtttgattatttcagacccgtctaaagcacatggatgaatgttcatcttatgtatataaaatatttacatattcttcctttccttgacaaaaattacttcttgagaacccatgctgcctgaaatgattaaaattacatgtacatgttcaaaggaagaacaaagagcttaagtagctaaattagtttggactagtgtgtagtgttacttcctaccattaaggcaggataaaaagaaatacaatagtttcactaaaaacgaaggttttgttcatttttttctcttcatttctctgtttactgctgcatgacaagtagagaaaagacgaagcatgttagaatccatggcagagtctgctatgtatcttggctctggtagactatcaaaacctcaattaactcattttcaaaataccgctatgatagaagtttctctccctcaaggaacccgattcacttatagttactaatctgcaaaaaggcacagggagactttcatgaagaaaaaagatacatatggtaaacaaacctatgtattattttctttacaaaatacacaagctaaagctttgaatgaaacaccaggtgggggttggcaagatattttaaatatttccaaaagctcagtaaaaatgttattgacattaaaacaaaagttcctgatcttgcttttggcttgcattgctatgttgactaaatgccctaattaggggttatatatgtctaattggggattacatatgatttaaagtgaaaaataattatcacatggtaaatgtagtttgtttagtaggcagatggtttcaaaaatatgaggtccttgtgggaaaagcataatgaacaaatccttactgatgaaaatgttggaaaccatgagcctgtactaatcatttggcaattaattgtcttctgtacttcggctgccagtatttattatttatatcttaacttctgctgaaagcatttacatagtctcacactacatactgttctgtcaatattttgattattttttaatcagccctatgaaatcatagatctttaaggaaaaggagatatagatatctataagaacattctgtttttctaacaggcagtttctggcacttagtgagtggtttccctttgtcctcctcgctgaccaacgggttgttggtagaacttttccagtcagatccgttcattgcactcattcaacaaatacttactgagagcctactatgtatcaattgttgtaccaaatgttaagtgtagttaggcaaaggagatatatatatatatatggagtaggcagagagtgttcaaggaaaagggaacaatttatgcaaagccttgaagcaggaaaaagctgggctagcctcaggaactgaaaggacagcaggtttaagctctgtgggcaaagaagagaacggaatgagatgagcttggagagactagcaaaagccaaatcatgcatggccttgtgggccacagtaagttcttaaaagtttactctccagctgttctcagtgaagatattggggcagagttggactgaagatgtcagg

SEQ ID NO: 161 - DNA, 1671 bp, Artificial Sequence
  Description of Artificial Sequence: Synthetic polynucleotide
gcgctctgtgtgcagctaatcctagaaggcaaaaaaaaaaaaaaaaaagctaaagttgcatgcatggcaaacctggcaaaaggtcgacaatcaccatggatgagaacgacacacaccaatggtggctatggccagattacgcacagcacgaaggcgcaaaggcagcgcgtggaaccacatgggacagccaggcggatggaaaccaaagacggcgaagcacaggagggtttgcggtggtctccgggcttgtctccgggtctgtgagtgcaggaatgtcatacgcttggatacctccaattctagacagctccttctgtccattctagacagctctttctgtgccgcttgtggggaggatgggagtgaatttctaaaatacttattcattttgccttggtattggcattctaatgacaaatattgaggttataattctaagtaaaataaaacttttatccaaagctctatgaacagctcaacaagtgaaataatctaaatgtccaaaaatatggaaagatgatataaactgtgatgtagccatttgatcagtatttctgagctactgggtacacctatacgtgtatatgtatatgtgcatgtatatgaatgggtatgcatacatatatttttttaaatgtggcccccgccctaggatctgtaaccctaaatgggttaggggactctggcctctttgcataagtcttgggaggaactctcttatgtagaggtcagagccccagttttccagccctccttgcagagagaaaatgggccgtggcccaggtcctgccagtcaatgctcccagcagggccgagcaaccaggggctggcaaagaccctgggaggctggctttgcccagagcagcagcagcgcccagcatccatggtgccggcacaggaaggcaagctccgggatgagtccggcggcacaggggttctgtctttctgtggttctgtctgtctcaggggttctgatcctgggcagcagccctgagttcgtggccaccacgcctggtttctcagcccttccagaagggctgcaagcgatgcaagaggaatatatttcttttcctttttctttttctttttgctcaaatggctggactggacttgctttctgtcgcttgcacgtgagaaggccgtctgagtattctggtttggcctctcaaagtttatggggaaattcttatgatatagtgcttagtaaaaattagtactaaacagctaatcaataaattataatagtaaacaaaactaaaattgactgaaaaacatagcacaaaaattctacaatctatatgagcaaatcacaaccagagatatgtaaaaaggggtaatatgtcttggccaagtagaatttacccaaaaaatataaaattggttcaagattaagaaaaaatatcaatggatgaaatctactaccttattagaataaaggggggagctatcatatttcaggaaaaaatgtcaataaaattcaaaatcaatttaagataactcatagtaaacttgaatagaaaaaatgtccttaattctgtaaggggcatctatgaataaaacctactgcaagcattacagttaatgtcaaagtactgcagctctccacctgtgatggttaacttcctgtgtctattcggctaggttacagtgctcaatcatttggtcaaacag

SEQ ID NO: 162 - DNA, 1670 bp, Artificial Sequence
  Description of Artificial Sequence: Synthetic polynucleotide
ggtccttctgaacttgacccatattctctccgatggagaggccagctctcagtctgactgaaaggatatgatattgagtcaaactcatggtcggcccagtgttctgtctatgacagggctcaaagggacattggccatttggcaggtggcagtccactttctgtgagtaaatgtgtcctcattaccaataacattaactggcccattacagcccctaattgttgctccatcacctccatatcacctgcagtgggaatgaggtcttcagtttcattttataaaccaacacgtgtaggccaagccaggtctgaccctgaagctctacaaaggcaagaccatctgtcccacatgagcactgtgttcctaggatgaggtcccaagtgaaggtggatgaaggatattgggggacttagtctgaaaaagaagaggatgaaccccaatatggtcatggtcttgcagtggatatatgcttatggtgagaaggaaggggccaggtgtcagccctctccactgagaacagagtagatagaagaggatttacattacagaaccctgagagatttagacttgatatgaagggaggtttttttcatggcaaagagagttacattctaaaatgagctcatagaaattgcttagaagttcatacatggctgattgagcaggggcatccatgtggaaagggacagactggacctgatatcaatgtgctgtctctgtctgttgtcctgagtgcagagtccagatagagctcctgacagagctggccttccgaacagcaaccactcacaggcaggctcagcggctccccttccctcctcaccacctcctctgaaagcgcgctcttctctcctctgccgtgcctcttctctgctgcaaagctcagtggacacgcatccactcctcaccctaccccatcctcacctggtgcagggcctgcccagggctgatccagagctggagaaaaaaacgggaagcaaggttaccccctaggactgctattgtgcttccttatttcaaccccgtggtccaccttgacgatgtatgaagcctttgtcttttcctggaggatttaagtaggaaaaaaccaactattgggtaggtgagcatgactaagaccttcggggcctgttgagattcagaagaccactgccaacaacaatgaaagcggatgcctagacactgactatgatgaagatgacgctgtagggtgcacaggagctaataagtctcaggtttgttgctgcaattaattgcaaagtaatggatataactttctttcaataaacaaacatttgtcaaatacttatggaacttggtcctgggaatacaagatcaataagatggacctctgcctttgagggcacagccatccattgggccagactaacctgtaaacgaataatgaattacagcaatcttatggtgccatagagggatttattcaataagctcagacaccacaggagagtctttttttaggagggatttatttttgaacgccttctacatgcctggcattgtgctggctgctggggatatgtggagaagaagcagacataagccttgccctcctggggcttccaactaggttaacacgcctcgctctgcctagggagctcagacaaggctccatgaaggagaagacccaagtcttgaagcaagaaagc

SEQ ID NO: 163 - DNA, 1670 bp, Artificial Sequence
  Description of Artificial Sequence: Synthetic polynucleotide
agccagtagcactgtgttcattacaggggtgtgtgtgtgtgtgtgtgtgtgtgtgtgtgtgtgtgtgtgtctgggagacaggaggtgagattgctttttttaaaggataatgaagggagcctctctgaaaacaatttgggagtaaatgtgaaggacatgagggaggaacctcatgaaatctgggggatagcaagtagatagatatctgggggagaatatttctgaggaagatacttttgaacttctttggattttttcatatggattatctatatgagtaatgtctatgctcatctactgcttttccagttgtgcttatcatggtagtagtgataatagtaataacaacaataatgtcatttttaccatgtaattgcaagctttgctttaggaactgatgtaaatctttcataagatcttactagagaattaattagctaattagttaatttacttattcattcagtcacacagtgagtgtttataaatgcccactgtatgtcagttactatgtgaagtgcaatgaacaccatggtgagcaggacgagttagtccctgtgttcgaaactgttaaggtggggagactgacaaatgaaacaggcaattaaaaatgcagtgtaaacagtggtccagtgtagttaaacgaggtaaggaaggtgcagcagggaaacaataagccaaacaaagaagaaaccaggtgtatgaataaatagggaatggcgaagctttctttgaattggggtgggatggggtgtatggaacagaggtgggcaaagtaggtgagataagtggctttggaaatgaaaccaagttttgtttagtgacctcttacgttgtcagatggggttaaatccataagggtctataaacattggcctgctatgtagaaaacacatgtttcaatggcaactaagttgtgagagaggttttcattgctaacgatgggctcctagcatgaagagattcaggtaaatcctgcctcgaggagtgggctgatatctctgatcagagctggctgcaagcttgagtagtgacaatggtgagatctccaaaagtgccaactcctaccacccaacacccaggagagaataacttcttactgccccctcacagatcctgagctgagctaaacaacctcttcagttctcgcagtccacctctctcccccgctactgccccattcatgctgcaaagatgtcacaggactgtctacttaaagattatctttctaaagcagagttgactctatgtattctgtaaaggcaattctgcttttttgttttttttcaacactgacccaagaacacttggatataaacagtaatatcaacatggtcaggaagggggaaattccactggctttcttgtttcatttaacattctttgacttgggggtgatattaaaaatataaaaatattatagaacattttcaaagtctacttgctttataagtcccttcaaaattttatttgtcctctatgttcatagcaattttaaagtgttagtctgtaaaatattgtatctacatgtacagctttgtttttgatagtcacttctagaacagattgaaaatcagtcaggaaaattcagtaagaccgatttgtggtttatccatattcttatgtaaacctgagattctcacatttgtcactaatgacagtcataaaat

SEQ ID NO: 164 - DNA, 1663 bp, Artificial Sequence
  Description of Artificial Sequence: Synthetic polynucleotide
gtgtgtatattataagctctttctacacatagacacacacacatataaataaatatatatataaatatacacacacatacatatgtacaaatatatatgctggaacacatccacacatatatgtgtggatatacatatgaatgagtatcaaaaggcatatacaagaatgctcatactagaaacattcaaaatatcctcatgaataaattacaaattgtgatatagttacacgatgaaatacaatgtcagtaaaaagaataaacttgctacacaaaatgaaacagatgaatctcatgaacctaattgaatgaaagaaatcaaaacaaaagaaaacactgcataattctatttatataaacttaaaaatggcaaagtatctatggtatcagaatagtcattatctttgggcaggaagaagagtatagtccttgagaaggggcacaaatagacttctgggatgctgatagcattctgctagtattctgcttcttatctggtgtcttagcttgggctcttctcgaaagtagaccctgaaatagggatttggatgcatgtaatttgagagttgatcacataaagtacaagtgaggacatggagaaggtaagacagggaagaagggaaagcaagcaaagaaagttgcactaatgagccgatgccactgcagacagtatgggcttattcttgctgctgttaactctctgagaaccatttggaacaggtttgtcctgctcatgtttcactggaggatgaggatggaggatgaggatgaggaggatgagcagtctgtgccacctaggaccagactcccaacctgttgtttgagggttgccccatgggaattaaccacccacgtcctctttctatcaacagtttttcattgtgacagagaaagtgcaagaccccatctttcccacatgcagttgaatccaggtgggctgcagggctatgatgcacagcatcagtaatgcctgttacaggctgtgtgctgattgcctggctgtgacaatttctcatgccatctccttatgactagtacgcttttatgtataagtgttacacttcaataagaagtttatttaaatattgttcaaagtaaatgcatgaactatgaatgcagtgtcattccagaaaaaggataatagctgagatgccttatatttaagagcaaacccttctcccaactactctggctcaagtttcaaggtgatccaatcagctagtgtttgtctcaataatagcagcatctcagagtcccttacatgacaaagttttgccaatatagagaatgatgctggccatgcaattcaacctgtgcttacaaacataattattcactcggtcactcagtcactcccttgttcatcgagtattgaatactcattcagtgagtattcaactgaccatgcagttggtcaaacactgcatgtggttctggtgataaaatgatgagcaaattcttcccccaccttcaaggcattcatagaccagtaaggaggagagatatgtcaccaattaaatatgacagaaatagtttagaaataaaacagcaagcctgggtgtggcggctcacgcctgtaatctcagcactttgggaggccgaaatgggtggaactgcttgagccagaactttaacaccagcctgggcaacagggcaaaatcctg

SEQ ID NO: 165 - DNA, 1660 bp, Artificial Sequence
  Description of Artificial Sequence: Synthetic polynucleotide
gctgcacacagagcgcaggtggtgttttgtcaacaaacgtttattgtgtgcctcctatggtagaggaacatgagatgcaaaggaaaaagacataataccctgctttattaaaaagcttacaattataatagaaaacatacctaaaagaccaggattagaggagatatttgcaaaaccatgaaaggggaaagcctgtagggaaaagcccagtctcactgcagtgggtgggaaaagcttcaccatgttgacccctttcaggtgagcaatcgcttccttcagccatggtagctgccaggccaatgaggctttgtgtgaaggtgaacccttaaacagacatggcctctgacctcatgagactgacagatactccaggaggtgctgatggctccttgttgagtgagaggaggtaagggagtttattctatggtaaacacaaagaagctataaaagaccctggaagattagcctggtcctaaaatgtccatctcatctatcaagagaagatacaaccagaatcaggagagtgttctcaatcccagcactaatcctagtacaatagcgtattgtagttttatttggtatttgaggtctattttcatcatccatggctgaggcagtctccaggccaataagcagatcaatcgctattcattgaaaagctcccaggtcccaattcctattttgcttcttgtcctgattagctgtcctataccatgtagaaacctcaaagagcagtttaattgtttactttccaaaaatcataccataagtcagattcctgttacctgagggtcacgctgaagttactggtgaaggttattgtcatttgggcctttgtcatttgacatccctccagcatgccaactccctttcttgcttaattgaccgccttactttgtgagttttagcacaaggcaaaaaccacctctaactgtgcaagaagtcatatttctgctttcttgggctcctgggaacctatgataaagcttagctaatcatttggatgtaagttggacattgtctcagaacctggaaactctgcataatcctttctggcaaaaaaaagagcagcttcttcccgtgggcacaggggtggtggattgagcagctctgtccttgctcagatgtggtgtcagcagcactgtctattcccaggataatcagtgacgctatcttcatgaaatgagctcattggcattgtttctggtggtgaagttccacacctaactatctggccttctcagagcttctgtgaactacccaataacttctaatacattattttctgttttaattagctagattaggtctcagttgctttcaactaagactactgataaataacagctttttaattactttttgttttaaaatatctccatgtatagacaatttaataatacaacaaatatccccccaaaatttatctgtatcggtcaattttaacattttactgtatttgcctcttgatttgaaaaaaaactttctgatgtcatgacattcattcctgaatatttcagagctcatctcttggatgcaaggatattctccacataatcactcatatactaagaaattttacactgaagcaataatactgcctagaagataactcatattcaaatgttactaactgttcaaatttgttatttatattttt

SEQ ID NO: 166 - DNA, 1659 bp, Artificial Sequence
  Description of Artificial Sequence: Synthetic polynucleotide
ttattttatttatcctattcaacagtttgtgtcaacttttaagataaagatgcatgtctttttttttaaattagaacaaattttcattatttttagctcaattttttccaccatttttaaattatatttgaaataataattaagaacatagcgatggctcttaatactgtacacatgttttttaacagcttttttatatttttcgtcttcctgactctgtgaagttctcatggagttattagttctaaattctaattgattaaaatgtcctaagaatctgtacagtctatagtgtgtaacacctagtttgtttttacttcaatcattacgtattttatcttaagcatgttaaatagctttttataatttacttcatctttcatttttctcttatatactttgataacttaatgaaagttatgtggatgctatcatatttttatgtctgaagtaattaaacacacttagtgtatttatttatctacaggaaatgaatcccctttctgagtttcttgggctacaagttattattatatttcagagtaatactagttgttttagtaaatattccttcatttataacatttcagaaacacctttttgttcatataacagtacaaaatggctgctttgtcggtagatgacctgacttctttccgtcctaagtactagctcctaatataaaagcctcatcattttctatatccagaagacagaaggggaaagagacgtgtggaaaaagtagattcacaacttagaatctttaatttgtaaagagttatcttcacattgcaattgggaaaataagtcatatgaggtcacaaatagatgtacaggaacctgggaagggggaccctggttcagtcgctgctttcaacacacagtcatggggactcaatcttggaaaggaaagtaagcacttacaggagggctagccgtttctggcaatacacaggtttttttcttcatgtactttggtttccagtttgtcagcacacccttgttctctctctctctcctttcctccgaccatcccccacctccatttattcccctcttcagttggttttgtggttgttttacttagatactcaagatctctgatcaaaaatactttctatattcacaactcagatattcacagctcagtcgtccttcatgatgttgactttgggggcagtgtaccgatctagctggtggtttgagtatgatacaggctatgaaactgtgtgtgcttctaaatccccaacagtaaaattttagcataaactatggcccagatagagtgtacaggtaggattgccttgtcccacctcaatttttaaaagtgagactggttttagttcccaacttaggctagtgatactgcccactgttactctacagacttctcattcctcaactagaatccaggttgctagcaatatcaacctctttttactttgaatatttgtttgatttctggttaatagaaacatcattttttgtttttgcttttgttttaagaggaggaggtggtgtcccaagggcatttatatctttgctctgtatttggaggagaatggagagttccaaatgatcagagcttgcacattactagatcccctttctataagtatttttttatatattttgtgagttatatttgttcatatacct

SEQ ID NO: 167 - DNA, 1658 bp, Artificial Sequence
  Description of Artificial Sequence: Synthetic polynucleotide
gctgcacacagagcgctgttttagtagagacatgatttggccatgttacccaggctggtcttgaagtcctgacctcaggtgatctgcccacttcagcctcccaaagtgttgggattacaggcatgagtcactgtgcccaactctcaagtttcaatgtgcctatgaattatttctgattccaggctctctcttagtgatgtgattctgcaggtttggaaggggcccatgaattggcttctttaaaaagtctcctcttaatgctgatgtttcttccactacatccaatatagtagcactcagctagagaaagtaggcacagcacagagctcctgacacccaacgatgttaccacaacacaaatacttttggcccaaagtggaagccaccagtcaccattttcaaacatgtcattttctgctggctctttacagtttagagagcctagagaaggcatcaatgtttgagtaagtctgcatttggaaaacatgtacacatgagttaatacaatgtttactgagcacatattatgtgttcaaaagtctgttacagagcaatgttcaggaaacttaacatgatgtgagttaatcctcataacaccctgggggttgggtgctaagttttctgtaattttcaggatttaaatgaagggcctagcatttctattttttcttccattttaaaaattatttacctggaaaataaaatgtgcagaataaaagctatatcgacagatgagagggatggagaaaaaagggtgaactgttcagagagatgttttatatttatatttacctttttgtgccttgtggagcagctactgaatttgcaggagtggaaaacaagttgctaggtggggtgtctctagaagcactggcttcaatgaaaaagaaattacagcccccaaatatagaattatttgcttccatttatctgcttttccattttaggaaattgtgggtaccagctcaggagaggcagcaagagcccccacctgaatctctggtatcctttaatcagttctgtgagagaagattctagggtgagaccagacctggatgaggccatagaagagggtggatctgggcagggctggaacagaaagtggaccccatgtttctgatgttcatgctggtggagtatttccagttctgtctttcgtaagcctgcccaacagagacttaactcttagagcttgtgtaattttaatatgttttagccactttcctgtcaatttttataacacatgatcacaagaaacttaagcaaaactcttagggtttttaggacaattatatgagaagctaaaaacttatttttaccaagataaaagaaatagaaataatcataacaataacaataattcttctgtccatgaatagcccttcaggtggtgacatcggaacccaaggaacagcataaaggaagaggagcaaatgcagccaaggccccctgtgcagctcccttctcccttccgactacaggatgatgaattcagccattaatccatttcccttccgaccacaggatgctgaattcagccattaatccgtttcccttccgaccacaggatgctgaattcagccattaatccgtttcccttccgaccacaggatgctgaattcagccattaatccgtttcccttccgaccacaggatgc

SEQ ID NO: 168 - DNA, 1656 bp, Artificial Sequence
  Description of Artificial Sequence: Synthetic polynucleotide
gctgcacacagagcgcccagcagcagcatgtatagaggctcatgcaggaagagaggacctaggaagccagatacgggccttttccagtccttcatagagagcagtgctccatgtgcttctcccctgctcacaggtgatctgtttctgtctcaggactgagatgatgacgtaaggaagtagtcacaaggcagtatggatagcaggcaagaactggggtcccggggccgcactgcctggattccaagcctgattttgcatgcatgacttgagacttcaggtaatttgcttaaactcattgtaactcagttttttctttataaattgatatttcatcatgcaacaactgtttattgtgctaattatttgggaagggtatcattttgggggctaggatatagccatcaacaaaccagataacgttcccttccactgtgcaatgttaagttctagaagggttataagcaatgcacaaatacatacatttcttccgggagataagagctgtgcagaaaaataaaggatggcaagggaataagcagtggggtagagtattttcatgatcagaacagtgttcactggggagatgacatttgaccaaaggtcagaatgccattaggagtaagccatgcatatacctgggaaatggtgttttgattagaggaaacttcaagtgcaaacaccctgaagctataagcatgcctgagaccatgacatgatctattaaatacagttgttgtgacgttaagtgagttagttcattaaagttgagcctgctagataaatatttcttgattaatattaggtattagtattatcagaatgcttcatactttctggcccagctggtccacttccacacctgacctgtggcctcgctaatgttgggggacactgccacctgctgcttcttgttggtaaaccattgagtgtgagtagcatgttgagaagctgatgtggagtctgatcttctgcccttggtgtccctgtatcttggcttcttctggctagatgttcactcagctccttaaatccactctgttttctgcttcatcagatttctaccattagtactgcctatgtcacctgtcaagtgtcagcttgccttccaacacagtgcctgacatccaggacaattgttgtatagggagatgtctttaaacacagaagactgctttcaatacatgtttcactagggcctgtgcttctgccaaatggctatctttggctttgagcctaagaacccatggagaaaaacaaagataccgagttatggtggagtctaatgaaagaaaaatggaccatctcccccagagctaccactgcttcaatgcattcaccatttaaggctggtacctgctcccacagactcatgactttctgaaacagctctgttgaatgcatttgtaatttgccactaaaaaaattatacttccacgtgtttacaaccttgtccatatctgggaaagtgacaagtagaaagttggctttctagtcctttctgaaggaagggtctggctttggtctgtctgtgcatacaatggtgctgtttggtatatgcagaagcctgggtacctacaggatttgcttagtgaatatatcttatatgaccttctggtccatcacacttacataatcccctaacataccatcccatag

SEQ ID NO: 169 - DNA, 1655 bp, Artificial Sequence
  Description of Artificial Sequence: Synthetic polynucleotide
ccctgagagcctcccacctgagactggagtcgcccctggcctcctcggaagcagaatcctccctgccagctcagaggcacctgcagacccaagagtgtgtgtttcccaagcagcggaacagggactgaggatgcccagggcaggcctcacatagaaaacccctccatgctttccagagaaggaaaccagaaaaggttattacgcactttagaaaccagtgaaagagaagcacacaggctccatgagctgggcggagaaagtgtgtcattcacgagcactgggtctgcagctgtggggacaggagactgagacccggcctgcaccctctttcttgtctctcaggatcaagctgaagtgggggaatggctcaggatcggaaataaatatatcactttgaaaggtaaggctctgagggtcccagaagcccccagagatgacagcttcacctgatcctaggaacatgctgcttgtctccaaggaattcattttcagaggcctgaagggaacctcctaggagagaaattggaacccgggatccctctccatgggatgaagccatggggtccaggaagcaggtgttgcccaggaggggaccgtgtgggggaggggaccagtgaccacctggacatgcaggaggggctgcaggtccatgtgggcagctgtttaacatggctgagccctctctgaggccaccctgtcctctctcctcaggaggtggtcgtgacccccatgatggggcgtgtcaggaggcaccctataaatgagaaaacgctgcccaccgggcatctggctatcactcctggggccctgtggccttggacagggatgctggggctccagggtctaatccccgatcccggggtctcccctaagggcacacgcactcggcctcctgtaagtcccagttccctccctcgccaccataacccatctcctgctttccagactgcagaattctcttgaaagaattggagaaccttgaggtctacactttcctgctggaaaagtgaggctcttccccttctctcccgtgtcctccttcctaccaggacctaggatgccaccccagggcctggggctgatctgggaggggagatcacggccgttatgtcactaaagccctgggcaggggtaggcagagctttgtgaagtcagcaggggggccctggaggtccacaggtgcccagtgctcccggctgcagcctgtgcctcctgtctcctgcaggcgcctgaagaagctctctagggagggcagctcccatcaccttccacgcccagtccgcccaggggcagtgtacaaaccagcaccttctaggaaccaccggccacgtggggggcgtgggaaagcttctcccaccagcttccatgtgtccccacgggctcccccggctcctctggcctccatgccgtcatcagtcccgaagacctccatagagtcccttgggtctccatcatccctgagctcctcccaggcatcagagcctctgtgtcccctgaagcacccttcacaccggccacctgcaagcaccctatcaccaaacccgaccagctccacagaatccttggggtatctgtcatccctcagctcctcccagccaccagagcctttgcgtcccctgaagcacccttcacacaagccacatgggcgttcccct

SEQ ID NO: 170 - DNA, 1655 bp, Artificial Sequence
  Description of Artificial Sequence: Synthetic polynucleotide
cgtagtcacatagatatttaggcattagaggctcagagggacctcacaggtgggaggggttgaaagaagaaaagcagaagaggacctcagaagcactcttaaacaaagtaagctttatatgtatatgtatatgtatatatgtatatgtattcataccttcccacacctatagaatcttacctctttgctttcttccagatccgattcactactaaagtcttccgtgtttaaattttcaaagtcagattctcctacagcaattggtacagtcacagtaagactggggttgtttatgaatgacctgtaatcactttcatcaataatgtatttttcaacactgctgccagttcctataccacttgtagttccatttacatctttaagatagtcaagatctttcccaatttctgttgtatgattggacatacaactgtctttcttgttgtttagatcatcaagtggtttaatttcatctaaaatcttttgtttcctaatgaaggactgttgaataaattcatatatttttcttttcacataagctactcctttgtgcatcctatccacagcaatttggagattattcatttcattatcatcatcagtggctgcaaggttgtctgcactaaatgagctcagaagcaaggccagaaagagattcaggaccttaaaaacaacaaaaacatgattataattttacaccaatatagggaagagcagattacaatcacttattctttcttttaagtgtggaaaaaactctaagttctaaaacttgatgagaaggaaacaccacagcatagtgattagaagatgggtgatctgaatttgtgactggctcaatagcacatccttggacaaagacatgatttctgttgctctcaagttctcccattcgtaaagtgaaattgaatgagctaatctaaggttttgttaactctaaaattgtatgagtagaagaaaacagatttatatgtgtacaatacgagaattcttaaaaatcactaatgtttccaagtatgcatttaaatgcattctataatttttcaataaacaaagatattaaattggatgtcaattgaaaaataaccattacaactcagaatgaagattaggagcttaacataggctgacacttgttttcttaatctattatagttctcatacttcattgttgactaagtagagctgtttatgaataatctctcatatttccatgagactggcacatgaatgtacatacctttagaatattttatatattactatactataaacagtaacactccaaatttaagagagataaagattgatcagttactccattatggtaatctcaggcatcattagccattcgagaactgatgaactcaggttggctagtgcatctgccatatgacatagagtgattgaatatcatatgctgcaatggggcaaagaaatggcacaagcattatgaactcttaaagacaccactttttagtcctagtctggatggtaattttgcactttctctctactttttttagacttctctcttccttggctctgaatttataaaatggtcccagcacatccttttaggctcatctcaatatgatactctattgtaattcacataaaaaatgtgataaagtgactgacaaaatagaatttgg

SEQ ID NO: 171 - DNA, 1655 bp, Artificial Sequence
  Description of Artificial Sequence: Synthetic polynucleotide
gataaagtaagaattatatacatttagtttcatgccttgatcactttctttagctctgaagaactttcagcatttctcacagggctgggcttcttgcaactaatatccttagcttttgtctgaaaaggtcttcagttctcttccaattctgaaggacaatttctctggatatagaactctgggtcagtggtgtccttctttcaacacttaaatacttcatttaactcttctagcttacatagaatctgtgaagacatctggtgggattgttattcttttcgtttatggatgaggcattttttttctttttttctttggctactttccagatttttctgttgggctgtagttttggggtgacttgaatactttatgcccacctgtagccttttttgtttgtttttcatttggcttggtgtcctctaaacttcctgaatctctgtttttgtgtctgtcatagattttttaaaaattcttgctcattttactgcagatatttcttctactcctctctcttatttttttatcttccttctgatattttaaatatccatatattgtatcttttgagattgccctacagtttttgaaaattttgttctgttttattttcctctttttgtttcagaagtttctattgatgtttctccaagcttgttgatctttgtcttggtcatgtctagttaattataagcccataaaaggcattctgtatttctgttttggtgttttcatttctagcattttattttgatccctttttagaacttttgtctctctgcttacatgacacacaagtccttacatgacatttacttcttccatttgaacccataatgtaccaatcacagttattttaagtgtccagtctcataattgccaaatctgtgttctgtctgagtctggatgtgaggcttgttttgtctcttcagattatggaggatccttgccttcaggatgcctcatggttttttgttcatatctgggcaatatggggttacgtaatagaaactaagcttcagtgtgaagtgtgacgtggatctactgcaaactgggctgtgcttaatgttttctgtagctgtaggtttcagggcttccaactcctctctaatgtacaggtttctgtctctcttactgtctttgtgtttccctacaaactccttctcaaatagagtttgagctgtgcagctgtttcagctgtgacctgctgttatttcatcagaacctagtgcggtggcaaggatggtggggagacgatgtgttctatcctcttatgatcaaatccaagtctgtagtgggcctgtgtccccggctgatacctgctcaggtgtctcctggatttcttaggtaagagagggacgctggaggaggggctgggaattggctgctggaggaggagaactgcccttccgtctgggcaggaaagcactggccaagcatttcctctggggagcaggtctgtgttcaacacagcagctttcttcttcctcctcgcagagacgtgaggtgatttgtttgactgtccgctatgaaaatctagtggggttccagggtgcaaacacacagaagtgtggggtccttctaagactgcagccccacgcgctcctcatttttgtgtcagtccatgacccacctcaagaaatttgtcataaaac

SEQ ID NO: 172 - DNA, 1649 bp, Artificial Sequence
  Description of Artificial Sequence: Synthetic polynucleotide
gcgctctgtgtgcagctacctttttgctcctataatatttacaccttggtagtctcttcgatctttcgcagtggcaccgtagctctgttttctgttgtgaatgaaaacaacatgctcctttttcccatgtagttttctatggagtttcttgcctccatggatccagcccaggtgaatgggaagaggcgggacaggccttgggtgggtggattaccagccatctccggggcttcccaaagagacgcaggatgtggcgtgttttatgaagtccaggctgcagcctccagcctgcttctgcaggatgccctgatggtagtgatggttacaaagcgcagctgaccagggcctcagagccaagctctgacgaaaacaacgtcctctccccgtctcactccttaaatcaccaggcctgctgcctagagatttcacaaggttgtcccaaattcactgctatgtaggtctcaggcttggaacgctcccacgacccccttctcacccccttcactttatattcctggctctgctccctgtcttctgcagctggtttattcactgtccaaaaatactggcaagagagtccccccacacacaattattttttttagtcttggtcttcacagctcttggaatttttattttttgctagctgacgtggaggccttagggaccatcggtgtttccaaagcgactccctaggcccgtcctttcctgctataatttatgttgctgttggtgggagttacgtcagaagactgcagggtagaaaatgcatctctaatttaccttctgttacccctcgacagtttgtgtgtggggaagagctggggagggaggggagaggaaggctcagatgcacttgtatgaaaagccagctgcatcccagcaggtgcagcaggggcaggagagtggagtgcagagctgggacacagcagggtcatcatgaggtgccgcccacatgcaccagaaagggagaggaaggcggctagcctgctaagacggcgggaggacggctggtgtaaggttatgtgcctgtaactggtttttgcttccacagtgaaaccccatctatgtgctttccatgtgccagcgatctggcattcatatggataatttttaaaaatttaagtattctacactgaagcataagttacatgtgttacttggacacctttcagaggaggccttaaacctgggatgtctgctgccctgagggtgcgttagcagctcgcagcacttctgaaaccctatggctttgccctgctctcttctcagagctcacagagccaggggccgccagggcagggaccagaactgccaggtttgtactgagcgtcctgtgtctctggatggtgaagctggtccgaactgctgttgtgactttatcttctggtctgtcttcgtttaatacagcaaacctgaaaataaaaagtggcatctttctcttccagcctctcttgattctacctgtccatccactctcaaagaaaggggcagatgttctgccatatgatcctgttggtctcagcaaacctttgctgcttctctgctctgggcttgtgtctatcaaggccccgaggactccacttcagcaggagacggtccttgttctgcaggcgcttgggaaattttggggtagagctcacctttct

SEQ ID NO: 173 - DNA, 1648 bp, Artificial Sequence
  Description of Artificial Sequence: Synthetic polynucleotide
gctgcacacagagcgccagaattgaggtgtgatttggggagtgaagaagatggtagggtttggactcattctttaggtggtggagatccagaatgtgttataagcaagggagtaacatgacatacttggttttagaaagggtagccaggcagcagcatggagaagggacagaagggtttctagccaatcagaagacctgcagtggcctccgtgagtgataaggaggccccacccggggtagtggtaaaagagggattagtagacaagatcccacaggatgtccccagtcaggtggcaggaaggtgaggagtgagcctagtgctgccaggtctctgctctaggtggctggatgacagaggtatcattcctgaggcaggcaccaggcatgaagaacaggtcgagaaagcgatgagtacatgtccaaagtgcctgggggacacccggtctgatgtggtggcagtgactgctagaagccctccagtctgtactcttcttccacagttagagtagaccaagaattgtagcccaaggtcttttggaataaaaatcaattttcccagtctccattgcagtgaggtatggtcatgggtctaaattctagacagtggaggtaagtggaagcaaccatgttgaaccatacgagtttaagtcatgtgctaaggaaggcagagccacaggacagaagaaagctgaagggaggtacgtggatgtgccctggctggctgcatttacacttctctcttgcttaaaccactactactttgcatttgtctttcatggccaaaactaattcaaccagtgcagatgcccaggagggtctagggcttcggacagattgggcacctatccatatcctaagcaaagccctcctgggatcaaccttctggcctgctctctctgtagggaggtcaaacacagaggcccttctgtgtcctcacagctcatggtacgtaggggacagacagctttctacttcctttgctctctttgccaagctctgagtgctccttggggccagggtctgttgtccatgtagccataacagggatgccagggcaccttccaggctagaaggaggctagagggaggttccaagacactgcctgtctaaagcagtaaattataaatagggaaataaaaatataaacaaccacgcaaacattaccctggagcttcctcggtagagacggcaaagctgatcaaatgcttgggtttgctgtggatccagaacaggttctgaggttccctgaaaaataaaaaccagtacgattaacaacatcacgtggctaggcagcctctcaacttgctctacacgatgctgaagcagaacatggtgcttccttcattctcctgaaaacaatccacgctaccagctattagtgagatatatactgaacatgagttagaaatcggcacgtcccctaagatccctccttggtgtggctgcaggttgacctgtctgtggacccttttcccaatggagtctccaaatgtcccgtatgtataggttcctttcaggtttcttgatccctctttggcaccattatgcagagctagttagttccttccagccttgcattcccatgtccatcacttcatacggccagcaaagataccgcttttctctgtcatggtaacaggagacgca

SEQ ID NO: 174 - DNA, 1646 bp, Artificial Sequence
  Description of Artificial Sequence: Synthetic polynucleotide
gggcagcctgtccacccttcttccttataagtcctggagtagtcactgccctgagccggggtccctctctgtcagcggaagtcagaggcactttgggtggggcagcgcaggagggagggagggaggctagaggtgtgagcacaccactggtgacaagaggtgggggccaagaagcaccgggaagcgggtgaccacggaagaagttcagaaccgtggaaggggcagctggcaacaggccagaccaagtgaaggaccctccactcccacccccgagaagcccctctctcttccagccaaccttccccatcccctgcctcaacatggtccttgccaaatgtccagggctttccctggggtccccagtttccagcccttctcctgggcagagggcccactcacacctgagactttatggtccttgtccccacccctggccagacacagaggtgacaaaaggccatggcccatccctgcccagagaaagcatcaaaggggcctctcccaagccagcacccaaagacccaaggggacacgttatttctgatcactctcgactcctcaggcagacctgactgcccacaacagcaggaacagaagggcccggtgccagcatagacaggctctgctgtgtgagtttgctatcagggtttgggggccttgtgggggatcaagatctttggggaggctcagctttacccatccttgcaaaaggtggctggaccaggcagccctagcccctggaccacccaactccctgaaccaacaccaggggtctaattgctccctaagcccccagtatcaaggtcagggcagtggtgggggtggggagagcatagatgacaaagcccaaggggcccctgccccgagtcactccccaataaaatgggtccccccaacctctgtgttttctgtgaggaacctcatggcccccaagggctgcccacagaccccctcctttgtccccaggagacacaggtgctcccaggatcctcctacagtgccacctctggaaatccctgttctctgatcaaacagagaccactgagggggtgaaaaggagacagacagagagctgctgctttttacaataaactctatattgtgcacatgaagacctggagatgtgccgacttcctgtccccaaagccaatcttccccgccaaggcgactgaggatttcaagggctcagaattactgcaggaatccaggtgacaccagggagagaggggggaggaggggaatcggaggggatgggtttaaaaggcagaggggagggagatggaagggaatgaggaggagggagactgagggggctgcctttccttggggactggggaactcatgccctgcccccacccgcagggctccaggggtgagagaaaggggtggagaataaagaattgggcagcagggtgatggggggaacagcagctggggtatttagggctgggggagtcgggggcagaaccgatgaatggacgggctcagaaggggagaagatacaaggaatgagagcaagagaaacggggaactgggcaacagggtgaccgagggaacagcacccggggtatcctaagacacagaggctatctataccttgctagagatcggaagagcacacgtctgaactccagtcacgagagtac

SEQ ID NO: 175 - DNA, 1644 bp, Artificial Sequence
  Description of Artificial Sequence: Synthetic polynucleotide
tgcagggataaacaggaagagaaaatggccttatctggggcaatggccagcaaatgtcacataagctaatgcaagattaaattagacatatttattacattgtttaaaattgagtataataaataagttattgtttaaattctcagagaacatacaactgagagattcctattgctattgaaaacttttctcccaggattgaggacacattacaaaaagctcttccctgtagctcccaagatggttctgtgctggaaagaaaaacagcaactgcagctgaaatgcatccagacccacctccactgtcaccactacattgctaaagaattaacatgcaggggcaaagccactaacacctttgtgttactggtactggaggaactcatagaaactgggatagaagaaagaaaagctccaaagccctgttcattctctcaggaataacagcctcatctcccacctcctctctctttcttcaggaataaaagcctcatcctgctgggaagggcagaaaagaggaagctgaagacatcagtgggaagacatagtatagtggctgctggaagaagatctgggaaaaaacaaggagaccctctacccaggaatgggaggaagatgcatggatcagcatcacacctgcaggagggcagggatacttggaaggacacaacctgagccaggactgtgatgtctgcctgcagtatggctccctcagaaggacagagagtgcccgttcagtgcgacccttcccaccacattgacaattgtccggtccatgtggctttagaatgacctgggggatttgaaagacagagtctctctggatagcacaagactaaagcccaaagccaagcaggaaacaaaattaaggtgttactggaggaatctgggtgtctggtggctacagaggaaatgtacttcaattctggcagccactgcaataaggactttcaaatgtagtcctgagtagtttcacacaattttctacaataaaggcctagaaaagatatggtgttatcatctacaaaaaatgcaaaaaatcataaaacaaataattagctgatataataaatctgatagaagtatctgcagaacataaatatcaaaataacttgcataaatacattaaaacatttacacttgatcccattgttagtctatgcctaacttcataagaaattgccaatatgtggtatacccaatactattataactaatactatattgattttatgcttgtaacaaagagcacagagtaggttctgtaagaactattaatgaaaaagtcaactttgcaaaatatttagatttattcgagccaaatgtgaggaccatgccctgtgacacagccccagaagatcttgagaacgtgtgcccaaagtggcttgattgcagcttaaatttaatgtcttagagagaaagacatcagtcaatacatatgagacatgtgtcgatttgtttcataaagataaaagagctacaagtgaggcagtgtggggaggggattacagcttacaggtgaattcaaagattttctgattgaaagacttaactttttatttaaagagctgaaatcagtagaaaaacgtttctgtgtttgaagggggccagcccctccacaactgtgggtatttctcgtcaggt

SEQ ID NO: 176 - DNA, 1640 bp, Artificial Sequence
  Description of Artificial Sequence: Synthetic polynucleotide
taacaatcttcctggtgatgtcagtgctgccagtccaagcaccacatttcatgtagcaatgctctatgcagcaggaaaaccaagatttgagttcagacccataatgagcattgataactggtagttcatgtcattgaagcagccaaacgcatgaagaaatattaagacagtccaggtaggggaagagacacttgtttcttttttctcccttctctctaaaccaaccttggaggagttggtcttaaaagtggggagtggcggggttgggggataggaagagatgattcagatgaagatcatgtcttacctttacttgactatgccaacgagtcagggtcccagctcaaggctgtactgtggcaattcgctggcagcacatgaaaccctgatggaattcaactctattaaacttttaaatactgaaagtgatagaattgcccaaaataacatcaaagcacaagaagattatacagaatattactaaaagcagtgattagaaaaaaattatttcgtatttatgcttttcaatcttaaaactattcaaaaatgtcattatatatatatacatttgccttgagaaaatatttcaactgcatttcaaagttggtatgaaaatgaagcacattataaaattatttttaaatgttaccaaaaagctgtgtttatgcaactcaaaattaaaaacatcctgtttagaataaaacacacatgtgcacacacacattttataatggagtcaagtcagcatttttatgattggcatctcttatctgtttaaggttgatcactttatgtataatgtgtttacttttttaatacaaacttattcagcttgcaagttattgagagatgtggtgaaatctaggtaatggaaaacatacaatgtaaggctgattaactctaaagagaagaattattttgtgacactgcataggcaacaggattggataattttgtggatgcataaattgaattacaattattgccaaaggcagcagcaccattagaaagcacatcaaaaaagtaaccaaaccagacacactgccagcgtttttaatgggtgtatcaattgtccctgaagatgttgctgaaaaataacttggtgagaatctctttctgctgtgcttcagaaaagggaactagaaatacacgtattccgttgacttagaaaactgtgcatatttttggatgttaagtgagccagctcatgcaaacatgcagacaagcatgtgcacacatgtgtgcgcacataaagcaagtttattgtgcttatctttttgacattcagagtggaatatttgtccatcagccttcagccagaaagctatattccctaaaaaaatacccatagagaacgtagcttctctatcctaattctgacattcgaaatccttttaaaactttcccatatgaaaaagagaaaaggtaactactgttttgttaagatgaatctactcctactcttgctcaactttagttccatctcttctaagaggttttttttttttgccatttcagtataaaatgatctatttatttatcattttcactcgtttgtcatctatctatcatctatatatctatgtatctatctatgtatctatgtatctatctatgtatctatgtatctatctatgtat

SEQ ID NO: 177 - DNA, 1640 bp, Artificial Sequence
  Description of Artificial Sequence: Synthetic polynucleotide
gggttcaaagcctcagggaggaggggctatattctcaagagtagaagaacaggaccagacccaggctcaggaatctctcaccagggcctgcggttggccacaaggaagccaaggcagtgggaaaatgactccctggtgctgaggatcagctgaaacagtgacttctcaccagagggctgcgatgagcaagcagctgacaggtcaatctcggcagacagaccaatggccggagccggtcttacaggtcttgagcaaaatggtttgggtggcctccctggctggagcatttctgagaccctcagagatgaattgtgctgagctcaccattttcacatttggttgctttctggagaacagatgtgagtgtcctggaggcctgagacataccaggggaccctcggctcctgatagaacagaacagatccaagcctgaagcaagtgtctgaggactcgtagtgggatgctcccgctccactcaaagatcgatatcggggtatatccccaccaccacatacactcacaggtcccgggtacagacctcactgccctcagggaagccccacccctcctgagacactgggacattctcttctccccattcattctcctcccagctgtgttgtgaagaaagaggacttggcagagcaggaatgcgttctggctagtctgaggattgctagagtgtgccaagctcagatccatgtgccagggaccaacggtgagtgtgtggtgctccatgggagcagggagcatgtgggtgctccatgggagaagcagcagcactcttctatccgagcttcgtgggaatcctcccatgagcaggcagggcagcccctccctcaatgccagacctggacaggtataaataatggagccgctcctggtggggagccaggcaccagcaccactgcagctcgggagagtcccaccccagcctggaatttcactgtggcaggaagggagggattgtgttaggctcaccagggagctttcctgctgggcaccccacagaggcagttcccaggcttggtgggacatgttgctcagcttctcctctgggtgctgctttccttgtcagcagaagacagtgcagggcccgccctgctgctctccccatcagagaaaggacagtaagctggctgccctgacctctctcgcagagctgtgcagggaatgtaggacctggtcagcatttcatacatggagaagcccttcacagacaccagggagagggtggtatccattcgtggaacaagggttaggcaaatcctgccatcccagcccaggattccttctcctcagagcctccactccaatctgtagggctttagtagaagatacatttaatagagcatgataaatagaacatgttccataaaacagcatttgtacatatcctctaagtcccccccagcagggcagtctccaaggttagggaacatctctgcatggcccacaccctcagcccagccttgggcactggaagtgttctgcagatattttttggagtgaattgacagacagaaaatcctcttcctccgctccttccccagattgttatgtgaagcccacaatggcaagaacctcaattgcttttgcaccaacctatatctacaccaacctatgtataacagaatgta

SEQ ID NO: 178 - DNA, 1635 bp, Artificial Sequence
  Description of Artificial Sequence: Synthetic polynucleotide
tgcagagccttccttgttcattccacatttatggttgaaacttctgtttctttgtctcttgagtggggaaggggccattcctagtgaggcttcctgttttggtacccctttcctgagtccaaacaggaagaatgtttgtgaatattccagatgggccatgtccccttatcaattggagccccaattagggtttgcatccagaatggttccttcaggtttggggtatttggatttgtttcatggagacaccaagactctggatcttctttggtctgcagccagaagcatatttaggagagactacacatctgctcaggtacactggtgggtagcacagatagacacatagagagcagtcattttctggggatccattctataaagtggggtggagtttttccgtttcacaagttagatgttgaaaattggctggatgtccagtaatgtctgacaggttgcccactcgcatccaagccacccatggccgtccttgtaaatggtaattcccttgctccggccatggcacttccttgctaaatcgtgttccctgtcaagcactggagggagaggccatctctgttctctcattatactgaggtggcagagtagctccctcttattggtctgatgcctcacttggtagcatcaaggcaatccgggccaacgcagaggccggcgctaagggccccatatggcggtaccgcagtgggagctgttggggtggagcagaggccaggtgcgttctggctgtggtggttggagctgctaaaacagcttgggtgtaggacatttaaaagtcctaattcttcttcattgctttctgcctgagtttggctatctggcttgtgaagagtcctttttccattctgtcccttggtacagctggcagctggcatcttccctcatggtatgaatcctgattttcaaaaagcatgaaggcttggacatatggtattttttctaattttccagacctctgacaaaatgagtctaactgcattaaagactagtattggttgcgtccgttcagaggtcaaaatttataacctaacttgtccacagtccaaacagcactgcaataatggaccgtttttctcttagtcaagggctcatagctataggctctacagttagctagggtatgccccaggggcctcccagaggtgatagagaccttgtttcccctcctgacttggtttctatacccatactgctcattcctgttgaaacagtgatgacaacttttatttgttgtctgtcttctgttctacactgctcatatccttcaaccagagctctatgggttggaaagacttttctagcttcttataagcagtgcaattagtaccactcatggtcctaaaaggagcacttgtgcaaatctcaccacacagctgggacagccaaagagatcagagaataaactccttgggcagctagtggttagcaccagctagcacagcactcccccaccaccgccccgccatgccccgaccggccccaacagcacatcaacttcatcccaggtccatgttctgctgtacttagtaccctagtagagggtaaccgaatggcaacaaattaaatggtaaattaggcacacaaaaagggcagagggggcgctctgtgtgcagc

SEQ ID NO: 179 - DNA, 1634 bp, Artificial Sequence
  Description of Artificial Sequence: Synthetic polynucleotide
atatagagacattttgcaagttaataacaacgtgacagacaatccaataaataaaatgataggtactttattgagagagttaaatcaatggtaaataagcacataagatgtttgacaccatttttgtcattagaaaattaatattgaaactgcaatgacatttgaatatacatctattataaagacttaaaatggttatataattgcttaaataaacaaatgagaaatatgacaacgtcaaatgttggcaaggatgaggaacaacagaaacactcataccttcctactaaaaattcaatatgttaataatagtcattaaaaaaattcagcaattttttatcaagttaaaatatgctttccatgtgactcagcaatcccactcctaggtctttacccaagaaatgtaaatgtatgtcacaagaagacatgtgtttttgtttgtaacttacacctgttaaataatgctaatggaacttcattcataatggccccaaaccacaaataactcacatgcccatcaattggtgaatgttccaaaagtttataatatatattcacagaatagagtattacttagtaataaaaagaatgagttactaatacacgctaaaacattaatacattttaaatatgttgtactaaatgaaagatgctagacagaaaagactgcgcactacatgcctccatttatatgaaaccacgagagcaggcagatcaatgtttgctggggcaagatgctagcaaaaacgtttgcaaattggaatctcagcatttttcatgggtgatggaaatgtttactatcatgactgtggtggtagttacactgctatttgttaaaacttattcaactctacatttggcaatttgtattgtatataaattatctcaaagctaatttcaacagataaaagagagatacaatatgcaaactttaacaaaactatgtattactctgttttatttttcttttcctctgcctgaaatataggagacctatgtcttcctccttccttatcgatgcctaatactacaaaatatatggcttgcaaaatcagatcaaacatctgcattttctattctataagagtctagtagcttagaatatttgttagaactgccttcaaaggcatgctaagcattattttcaaaacatgtaaagaatcctatcattttaaaacatggctacagaggttttcaaataaatagaaacataaacctctgctatactgccataatttgactatagagttgctcatcctgataaaaaaagatacgaagagttttagccaatatatttttgctaaccaaatattcagctcatatcaagacgaagtcactaatttattcatatatttatttttaaaaagcaagtagtagaacacactaccaaatatatttttttcagaagaacataaagttgaatatcacagagacaagccatcatatttgagatggtaatcaaaaagaaattggagttgttatgtgtacaaatttgagagaatcactcaagtaaaagttaaaagttaataatatattttctttctttctttctttccttccttccttccttccttccttctttctttcttttttttgagacagagtctcactttgtcacccaggctggggtgcag

SEQ ID NO: 180 - DNA, 1630 bp, Artificial Sequence
  Description of Artificial Sequence: Synthetic polynucleotide
gcgctctgtgtgcagcagttatcaatttatggaaaatcatggcacaaatagaagatagaaaaaataaattgttaaatgacaatacaaaaagtctttctctaactgtcaaaatgccatataattagatggatgcactaatataacaaacagaaactaatgaaggaggagtaatcagcagtgataaaagggtagacagagggcagtggaattgaacagaggaagaggggggtgaaatgaaggcaagaaagtaaggaaaacatgagtatttatttaaagtgagtagttggaggctaaaagggaagttgcaccaagtttgggtctaacatgttgtggtagtaactgtgttcttcatattataggtaaagaagtcattgactacttttaaatagggagattaggtggtcagtgtagagttgctgggtgagcagaatgcataaatgtgcctgattaactaaagatggcaaggattatggatattcaaatagcctttcccacctctgttgatgaattggtagtaacctacatcctgttggtaagtagtcagtctagctaggaatgggctatccaataaatattgtgagaggaaaatggaaagtagttagatattacatttgaagaaaaattaataatttgaaatgcctctagggagcttgtaaaattggtaggatgacagtaacattaaacagaaggaaaagaaggcaaatgggaaataaagttttgagagtacgtttctaaacttagtgaattaaattgagggttattaaagaggaaatttgagccagctgattacaaacacataatcaaagcttctgagcagtcacaaaatgagataaaggtttcagtgttttcacgaaaaactgatatactaattcctgtgagtaaatgagatcttcaagaaagagaatgtaaaaattgaagaacttaggacatgttgttcaatcttagggaatagacatttgaaagaaaaggaaggaacatgaggaatgaagggaacaaatgagaaacatgtgcctgctatcaacttagagttggtgaagcaaattggtaaacattggcgaattttatggggttattgatgacccaaactctaagcttctttgtaaattgggaatttttcaaaataaaatgttctgggagatggtaaaacaaatgtggagaaagcaagtccagagtgcagagctcaagctaaaaaaaaagcatttgattttgtgtttgagaagataacacttgatatttaagattttcatgcctttaaagtgaagttgcaggcattgcattgaaaaaggtttatgcagctatagcattgacgtatagagttagaagttaaattgaaaaataaagttcgaagtgaaaataatttatgccatccgtcataatattaacttggttttaatatttttttcctctggtttttcaaaaagttgtggaaattgacgaagtataattattctaagatggaataattaaaatggcattttaataagcaaatgtttaaatatctgcggaaaaaagggaaatggaaaaaagattcagtaaatgttagctacataataaagtgtatactgcccaattatttgtcatgtctgcctatctatctatctatctatctatctatctatctatctatcta

SEQ ID NO: 181 - DNA, 1628 bp, Artificial Sequence
  Description of Artificial Sequence: Synthetic polynucleotide
agcaggcagaacatggaggggcagctcaggatcggggaagggtctcaaccactagagtgttttggacaggaatggctgtgactgtgagggctgaaataaggggcacagttgaaagaaaaagcaaagggacaaactgcaaagccaaggttatcaaaggggaaagaagagcatccctcgggagggagcaggggtgggttgcaggcactgggccatggtcatgtggcaggcccagtgatgcacagatggagacagtgactgcttgcatccttcacagatgggtcttccttctgttcatgatgcagaaagcactctggctgggttacatctacagctcgatcactgtccagccacaaaaccaccagcaagtcaccagagccctctagacctcaatttccctatgtgcaaaatgaggttagagtaggaggcctctaaggcaccttctggctctaacatcctgtgtccagccaggccagccattggacactgaactaattcaaccatggtcacagaggcaagacccttggggaccagtggaaataggccaaggaaaagtcttttcccagcccaaagtctccagtcatctcagtcacacagtcactcaccgcaggggcctcagggagaacaagactaagaacaaaagccccagctactaagaagcaacccaggatgaatgcaagactcctgtgttcagaagtagcagttctaacccgggctggaaaatacacagtatgttatgagaacattatgaataaccccttgaccagcaattctacccctaggtaaatcctagagaaaatcacatggatgcacaaggaaatacaacaagaatgtgcatgctggcattgtctgcaactcaaaaaacctggatattacctaaatgtggaccaaccagagaactaataaataattgcagtacatccatacaacggaatactacccagcagtgaaaatggacaggcgagagccatgataccagcatggatggatctcacatcattacactcactcattctctcaacaatcactcacaaacacaagtcctctgtgccaaggtgttgttctaggcagcagggacactcaatttaatagatgatgcccctgccctagtgggggtagagagaaaagaaaccaccattaagtaacacacatagcctgacagactatgttgagccctacagagaagcatcaggcaaggagaagccaggtggggagaaggtgctattaattgtttaagcagtggtcaggaaaggccaaatcacgtactggtcatgcttcttattttaagctgagtggtgggtgcacaaggattcactttattactctttataccgttttctaagtctgatatgtttcaaaatgattttcattacaaacacgactgataagggaagtcattaacagatgagagtatacatagtcttccacctcgaatgtaaatgtatcccatgttcataagcctgattcatgtgttcccaccccccatgaccaaaccccctaccttggaaggctggtccctctcaagcaaggttttcaacattgagcagtgttcctggaaccctcacagagcctgtcgctaccaagcccggcagggaaccttgtcagagatctgactttcgatgctgaacgat

SEQ ID NO: 182 - DNA, 1625 bp, Artificial Sequence
  Description of Artificial Sequence: Synthetic polynucleotide
gcgctctgtgtgcagctaaagacaagaattttaccctgttctttctttgttctttagtgctctctcctttttgatatttagcctctagtttttgggctagttttcacaaaggaagggcctcacactgagaaacaaagtactttagatggtatttgaaaacactatccttcctcacatggtcttcaaatgaaatgtttgatattatgttataaaacagttcctcatatttccctttgtatgcagcagagttatagtcagtgccccagggcccttataaaaggaggtgtgcccaggcccctcagcaagctttaggtaccgggtgcaggtgactgtgggcactgtgtgcttgctgcacagaagaatgtggttgagtcatggggctgggaatcctgtatgtgcagggaaatgtgctggtctccttttttaagcctggctgtgaatcttccactgatcttctctctcacagttgatagcatttgtatcagggaaatgaggccttcctcaggatcctgcctgaaccactgaagaaatctgaagggctgtctctgtaactgcagttcagtgtgacgctgtcaccttccttgactttcagggaagaagcattctgttccactggcagttgtccatttgaccctgcttaggaggaatgaaacattttcatatatatagtgtgtttgttcatcagtttcattatttgttttacattcctgagactagacccaagattgtcccagggatctttctaaatttcaatgccctggccgcccctacttgattcctcccctcctcatgactcccctgactcacaggtcagctgcacacagaggagcagcgggagagtgctcagtggagtttccattctttccttttcctggagcctctgtggattcagtttggagacctagatttggccgtgttcactgggcctagttcactgttctagagtcttctggttctgttggttgggtagcctttggggaatcttcattgtttttacggacaatcaaaacctcactgttacatcacacacatcattgaatgccctcctcctgctgttcccttccccttgttctagtttctggcagtgcctctgtcaaaggaagccctgcccccaggtggtctgaactcaaaaaaattgttttttcatttcccccttaatataaagtaactcattatgttgaaatgaaaggtagacagaacatacagagaggtgaggagcaaacaaaaaagaaagaaagcaaacagtgttaaaaggaaagtttctccagttatgactgtctgaaaatcctttacacctgaaactccctcactcccctcacctttaaagaaatatgcaggctctttgcctctatggcactgtagtacattctgaggggggtaggaataggttgagagaagatctaattatttcccttaattgattatttttctaccagagctgtattatatgtctcaatctcagcagctttaaataagctaaaagagttagaccttttccaaattctcgttaaaaagacaaaggaggaaaatgtagtatcctttcttttaggatgttttcaggtgtgagaaagcagtctagtaactggctaactctgagcatgctagtgcttttgcaaatatccaag

SEQ ID NO: 183 - DNA, 1614 bp, Artificial Sequence
  Description of Artificial Sequence: Synthetic polynucleotide
tacagctaattttttgtttatatgaacaaatattgatgagccacattgcaaaataacaaagaacttctggtgtgggtgtttagcatagtctcatttgataggaaaactgtgttggtggcacggattctgttatgtccctatgatggccatcagtggtccatagaggttatgaatgcactgggttagggttgtcatgagcatgtggatgaaacaaatgcttatggttcctcactggaaaaccccactgcaaattaatcttcaaaattggttcctgtttccaatactgcaggaattccagccttccgagttttattacaagacaatagatagagtgagcaggggcacacatttccgtaaggaagttgtgatgccctgtatttcagctctacaggtaggagccctataagagttcacattgtctgaatctgatgattttgcaatcttttctaacaatgttgtccaacttagctactgcctcttctagtctttggcgtttgctttcaaattctgcttgtccatctgttatttgtcctctggcattgttgcctgcccattttttcatgtttttctgggttttttttcctgtcttcccagtgattttgcaatatgagcctactgtttgatttttctatcttgctccctttttgaggacaggctatgagaaattctagaactggagagaagtgtagggtcttatttctctggtggcgtatgtctgcatccaaagtgcgtgtttacagaaacacagggtataaagctctatgcttataaagccacaaagttaatgtggactgttttcccagaaaatttgacatcacaatgagttgaaacttttattgtcatcaatatgggtctgttatagaaacggccaatgtgttttcttgtttttaagtaaatataaaaacaatattgctgaatgcctctttaggttttgcctcaagttatctctccctgctcttagagaacatgtgtaaaaaaagcaacctgggaaacactgactaagccatagggtgagtgggggagatcctcaatgcatgcccctcaatgcttcctgagcaccaggcactgtgcttgatcttccgcatgtatcatcctaatgataatctttataatacatggggccacaatatttacacctttgacaaaatcaagactgaaagagccaaattaaggataacaggataatgttattcccattttattaagtaacttttctaaggccatgcgtaagaaagatattaacacagcattttaagttgagagctgttctccccttataaggagaaaatttttgctgatattatggtctgaattgtatatgcccccatccccaaaaaaagcctgtgttgaagtactaagtcccagtacctcagactgtgaccatatttggagatagggtctttaagggggttattaagttaaaatgaagtcattggggtgggccttaatgcagtatcactgattttcttattaaaaaggacacagaaacacacagaggaagacgatctgaagacacagggagaagacagctatctgaggccaggagaggggctgcagaaggtaccagccctaccggcaccttgatcttggacttccggcctccagaactgtgag

SEQ ID NO: 184 - DNA, 1612 bp, Artificial Sequence
  Description of Artificial Sequence: Synthetic polynucleotide
gcaatttccaccttaacctccctcctctcatgcctcattacaacatcgctaacatcaagtccaacattctaatattacaagtggaaaaaaaaaatgatctgagactgtgaactgtgagaactgtcgactgtggtaaattttaagcatgttataattctaggcctgaaaactaagagataacaaaagaaatgtaatccacagatgcccccttctttatgctgcctacctgcctttgtactctttctcccaaagtcatcttctgcatatccttttagaaacttgtgtcccattttcattttcccaatccatccacaatggcagcgaagcgctctaccatccttctacctgcacacccttcagtagaggtaaacctcttaaggagagggaggcaccagattagaatctacttcctcactgcccggtctgtcttccttggaaaaggaaaagggaagtagatattgaataagcgtaccattttacctacaaggcacacagtaagtggttgatccaatcaacacaatgccaggttgaacattatacacaagtcattttattcttgtgcagatgtttttataggaaagagccccagaaatggggttgcaagtcaaataataaatccacatgtaattaggttaaatattttcagatctccctccatatgcgctataccactttgcattctccctagaaatatatgagtgcctttgttttctcccaactttgcaatgaagtatgattttaagctgctggattgttttaatctcatgaaagagaaattgtttcttagtgtgatttgaatttgcattattataactgaggtgatcatatgtttaagggccatctgtattctcccttaaatttctgcatttggcagaaggcattttgtaatccaaagagctatttctttaccttcaagtcacactccgtgcacagcccacccatctgctgacctatgtaagaggtcaatgctgcttacacgtgttttgggactaaatgggggtggttgtggcatttgtgtcaatggagcaaaggacctagaaggcatcataattcacacagtcagtctttagttgatggcttggcagaagctgaatgaagtgtgtgaaggtgactctacagagcacagtagtaaggaggggttgcttcttctgtaagtttacatctcatgctattttgggatattgcctggatgacttgtcttctcctctaacatataatattcagagtgttttaagttgtataaatcttaagaaaagaaaaagggagaaaagaaagggaaatgctaggaaaaagttctcacatttgacaatgtgatttatagaactatttctaggcacatcttattacatcaaagtggcagtgtttatttttttacaaatgtgtaataataaggatcttgacaatgcacccctccctttcagattacctctagaaatatccctggaaaactttaagatgaggcaattgtggcataaagaacaggcatagagaaatgctttttgaagagtgtttgacataaaatttctattaactgttaataagcactttaaaaattgttctgttctcaaatacgtatgggaaatgccggatgaaataaagataagcaagctct

SEQ ID NO: 185 - DNA, 1612 bp, Artificial Sequence
  Description of Artificial Sequence: Synthetic polynucleotide
ttactgggtcccttagacagacctcaagggagatcttcccgaaacagcatcccctgtcagctggaagcagttaaggttggcctttgtctgtattctaacggcagttagatgcacttattcaaagaggaaaatgatagagggaggaggcagataactctcctaggcagacaggggagagtccccatagaatgtccaacccaccaaggtcattgtgcacagggggcttgcctagacatgcctgcagtgaaaattgttagtattgtatcttatcactctgataaaatagccacacataataatccagctgcgtgaagataaaaaataactagtttgaatttagagcaagtcccaagtaaatcaaagttagcatgtggttcataatgtgatagacaggagacatggctgaatatgaagaatgtgttcacatctattttgtgtcgagatcaggaaaatattttgtatattacttaggtaagattcccactgagatcattgatttaagattatatattgatggataatacctcaataataaaagtagaggttattaatcagtaatttgtattactagtacaaacttccatttagtatatattattctgtgtgttatgaaatcaattcagaaggcagaaaactttgcacttatcacaactttttaataaattaaaaattagaattaagtaactatgtttctagatggtgcacaactttggaatatttttgcaaacagagagggttcttacatcttctggaaatcctatcaaaatggacaacaatggaagaaactttcagatgaatttctaccaactagagatctgattaatagaattttaaagcaaatgctaacacacaaacaaaaaactaacatagaagctaaaaaaatagtgatttaacacaccaaacactctacctcattctagtttataacataatctaaccgtggagggcactgtcattgttcatacgagacagaatcaataccactcacaatcttctgggaatgtttaaaaaatgtcatctttacattaaaattatcaaatctttaataaaatgtaataaaatgtaaaacttgcttggccaagggttctcccactagcactatgaaaccatggtccactcctcaggctgcatcagttattaccctatgacttggcagctaaaaggcctatatgtttatagactctaccccagagatcatccttgtcctactgcttgcatgtgtggtacccactccaaccacgaagagtttgaggcggcctttttactacctcttttccacaggctcttgtgatcttcaacaaggaaactggaaggaacatcagtggacaatactgctcttgaatcatattggaaggaatcttgtcagatccttttaactaactcactgcagaaaacattcaggaagttaattattgggttcgtattttacaattaaagaatcaattcaggccagatgcactggatcatctgtataatcacaccactttcagaagggaagtgagggaaatcccatgagaccaggcaatcaaaaccagcctgggcaacacaaagagaccttatttatatgaaaaaataaaataaaaaataaggaggggggctgcacacagagcgc

SEQ ID NO: 186 - DNA, 1611 bp, Artificial Sequence
  Description of Artificial Sequence: Synthetic polynucleotide
atgttctcatacctgaggcaggtttcattcatcctttacactgtttctaattctacaccttctcccagtttctcaatgtgctgggtccagataaacctacctgtttatgcccaaatgaacattttgcatagatttctagtcaccctctccaattgcttttttgtaactttcgctactgtaaaagttaccactgtcttattataatcgtgtgattacctttcaacttctcccagtaggctatgagcttctgaaagcaaggttctgtttctcatttatttttaaatgtatttgctagtcaacaaatgtttggttagtgagtggatgaacaacaattgaaaccaagactgtgcattaaggcctcttaatcattgttttgaatttgagagatggctgcatatggggtgattaacaattatgtagagcctcacctctgcccaatatttctagtgattctatttaaactatgattggaataaaggtttgatgtgcagtttgatgtgcagcaacaaagaaagtaggaatagattttttcatattcaatcattcttcaatatgaatctgcctaaattactgcatactagatatatcatacattctttcagatcaattatagtttactgactaaacctctggccagaaacttaagagttcatagcaggtttgtcttgtttttctgagtcctcctaataacagacattgagaaacagagaactggtattatttttatgaattctgggaaagacaataccattttgcagttttctgcctaaaataatttatttcaatatgaagcggtaatattcgtacttgaaatatccattaaggcgtcagtctatccccattggtagtggagagtgaattacaatgaaaacttataacaaatggaaaattgtctttagtaaatgtattctatgtagttatccagacagttctgagaaaacagaatatcaattattcaacacaaatacatggtacctaaaatattggaaaatctgtaaagttttggtcagattcagctagcagtgtggtagctgctctacaaggaatgactgaattcgtctatagcatattggtaaataatgaaggaagaataacgactttagtgaacttgaatcactcatttgaacaacagatcctagactatacagatatagatgacaaatatatccttgtagtggttttaacactaacatctctttaagaagatctaagggcattctctcagaagatattgttaactcaaaaccctcaagctttcacataatcagaattgagttattatttttgttgcctctctagatcactggggttttttttttttgaaattttataaatagtgaaagggatttctcatcctgctatggtttggatgtacatgctcctgtaaaatttatatgttgaaacttaagccctgaggtgatggaaggtagacactttgggaggtggtaggtgatgagggctctgctttcattaatgggattaatgcccttataaaaggggccttaaagacttcccaaatcttccagctccttctccaagtgagaatatcaatatggaaccatctatgagaaacgaaccctcaccagacaccaaatttgccagcaccttaat

SEQ ID NO: 187 - DNA, 1605 bp, Artificial Sequence
  Description of Artificial Sequence: Synthetic polynucleotide
gctgcacacagagcgccaacagattaaacagattagcccgtgagctgtgaccagaggctacacctgatcctacagaacccaagagatccagtcagcaccatgtcacaacccatgctccatacatgagcttttcaagatataattgtagggcagactgcagtagtggattcatgtgcccatgtccctgggtaaggctctttcttctctggattttgaaagttccttctacaagatgtagatgcctcatccatcctgtttactaagatcatagcaatttccctcctctgggaggaatcaccttccttcctttgtgttttgccagacactgaggaatgaaagccttcagcaaaagtattaccttgcttgggtttcaattgtaagaatttgggagaaatcagccagacctgaaatgtcttcacatttcatggatttccagtgttgccaacttgtctcggtacaatccagcagttcagagtgcgggagactctattacgtgtgacctagtgactcaagatccttccatcatttgaatctatcatcttcagcaatggctgtgtgaatctcagagtgacctggggatagtttccgaaccacctagccatcttcagatttggggctgcatttggggagggagcaattttattttctttctttcagtcacagtccccagtcccttttggcctacacttgagactttgctataaacaactccattcacttttttgccacgaacaactccattctgctttttccttggaaagaaaagggctcttcttttgtttgtaatatactttatattttaaatccataactattttaaaaaattaaaaaacaaaaacattgttcaggccaaagaaacagcactataagacaactgccaatcagcaacttctgctgaagaggttctagatgagggaatggaggatcagaaatcttcatgacttcagtaagtctggcatagtttctgtgacctcagtgtccaaatgatagttcaataatacagcgatttctgatttgagatgtctgatctgattgtgcagaaattaagagcttagacttgatggctgggaggacctttccagagtcttagttgtaggtcccaatgtgtctttgctcccttatttctaacataagggtataaatatatatgtcttagggttatggtgagggtgaaatgggatagcgaatgaaaaccactatccccattcctgcatgtagtaatcacttgataaattgagctattactaaattttagataggaatgaaaatttaaatgtgagctagtgggaaaagaaagtacaggcctaatcagcttcattggataagcatgactaggcactgcatgcttttctccatgggcctaaagaagaaacctctccagttttatagcatgaatcagaaatatgtgcttcggcattattttgcaataaatacaaataaacaaacaagcccatggatttacatagatctttcaaaagaggggtggaataagactgtagctcttgttaacaacattgttaacactgaacatccaagtgcacaagtcatacaggagggtgtctttgtcagttgacaagtgaaacattacacatctcggttcatcca

SEQ ID NO: 188 - DNA, 1604 bp, Artificial Sequence
  Description of Artificial Sequence: Synthetic polynucleotide
gcgctctgtgtgcagctcttaagaacttggccaacaggtttattgttataatccagattaatcatttgtgtcacaattgttctgtgcttgccaaattccttttcccccaggagttaattctcaggatgtgtatgtccactggacataatcaaaggtttgatacatgaggtatgagaatgctttctgtctcctctatcagacataacaattgcattcatgggcacttggagttctcacagtgctttcatgtgcttgtgcttgtcacctcaacctctgaggtaggcagaggacatattttcattcccattttgcaaaggaggaaagagaatctcagtggttatgtaatgagtgacttgtccaggtcacacactgcataggagctcagagctcttcgcttacgattttctcatctccctggctcaagcctagttgctagtgtgcatttctggtgctcaagatggcaagattaggcttacaccgtgagtgcacagaaaggtaagaaagtgctagtgcgaattaatttttgatgtgcaaaaaaaaaaagaagttttaagtttctccatgtgcattatttactttatttagtcggagaagaaaataaaaatattaatgaataaaaatgctaccttttattaataaatgactaacaaaacactaattgcttgtagagatgctgagttctttatgaaatatatcccaagttttgaccttaaacaaatactgataaagcactttcattatcttcatttggcattgatttcaagtttcagattatttccagtggttttctggaaaacgcagcgtgttcacctctttgctgtcatgttctgtagtgtgtttgcaaattcacagacttggaattagaacctacggaggtcacttagattttcaaagaccttcttatgacatttgaagtattcctagtgttctgcaaataaagtgagaggccttgtagggtgtggctatgcttgtgacctttgttagtacaacttggaagaaaacccaccacacttgtacccaggtagaataagcatttacactttcaaatgacagcttaaaataactgacaaggaaaatttaagtttgcaagttcaaagcccttgagcaactggaaatttacttttcaaaatatagtgtcgatttcaaataattattgtcacaaaaagtcagagcctcttgaagcatatctcagacataaaagaataataaaatttggcagcttttgaacttacaccataaccagttaagataggtccacattagttctaggaatcactgagaaaccatactcaagatttcaactcaaagagaacaggctctttgtacttgctatttatccagaacactaggacatggttttaggcacttattagactgactttctgagatcatctagtagtagatcattgaagtaaatcacatggggaatgattattaagaattgtggtagaaaaaaagaaaagcgtggagactgaaaatctagttggagatgggagtcacaagaaataatacagaggctgcccatccttgtttatatgtatgtttacagtatctaaataactgtgataagtgagtcgtttatttgatctgccatcctactatgc

SEQ ID NO: 189 - DNA, 1604 bp, Artificial Sequence
  Description of Artificial Sequence: Synthetic polynucleotide
ctgggcttttctattttctctctccagcccctccgtaggtgatccatccaaggttgtggctttaaatatgacccatatcctcaagacaataatttctttcctatctatcttctaaatctctcctaaacaccaaactttattaaactacatactagacacctccgcattgattgtgtgctatttggattttttaaaaaatttatatataagtgatacctagatcactagctaaatgattaagacattaaattcatgtttacagctccagaaatgaaaactcaaccaatttcctaaagaacagtaacacatcatatcatcaactcataaacatctgaggatagaagtgagtttccaggaactgcacagacaccaaatatataatgacgtgatctgagtctgaaagcattcagtgaggcctgctgtttataatatggcctcactggctcagggtctaaacagaacatatatggaaataaagttttgactccttcctctatactcaatctatctcttcattagtcttctccagctcagtaattggtaaactacatactctattattcaaataaaacccaaagttcatcattaatttattcctttccttgagtccaaacattcaggtcatcaccaagtctttgatacatgtcttcaatgtgctcatttttttctctataactctaattcaagctaccataaccttttttcctaagattattttcacaacttaattggtttccctgcttctaaccttacaccctaaaacccaatgttcacacagtcatcattataaaacataattcagcctacactatttttttttatttacctgcatgggacagtccaatgacttttcaaatactttatctgcatttatgatataattttacatatttcctagactacttgtcctacactcactatactccagaatataggcttcctttctcttcattcaaattgataagctctcctgcctcatgatcttaacatcctgtttccccctggctttctgtgtgattggctcctctcatcattctgttttctatcctaacaccacccccttaccttgcacataaagtaccttatttacccaatttgctctttttaaattgctctctttattctagaaatttttgatacttaaaattaacatattatttggtatataaaacaagaacagtgatttttatgtcttaatcagcatatttccccacctcctaaaacagcatatcagaatatctactgtttaatatatatttgatgaatgaatgaatactctcagggctagagccacactctggaggcctattcccgatcattatgcattttttccatctggttggaatgcactttcctctgtatttagtccccgaatgtacttatcctttcgccctgctcttcactcaattgtggtgagatcttatggagagtctgttaggttggtccttggtctgggattgcagtggcctctatacgatagtttgtttttgccatggaacatagaggagagttggtcatggataattgtacttgggtacaaatttttaaaaaagtacaaaaaaaagcaaaacatctttgctttttgagattttccttcttacttt

SEQ ID NO: 190 - DNA, 1601 bp, Artificial Sequence
  Description of Artificial Sequence: Synthetic polynucleotide
gtgaaaagcagaaccagactgtactcagctgacatctgccaatggagggagcatttgtattggccctagcaagaggaaaatctcccatcctagtgttgggagcttgagtttttgcaagtcttgccatcatgagttgacatgctattggactctaagagaacttaaggggcagtctaggccacaaggacttcaattattacccaagtcatacttctagctgggctcagagccagtggaaagtggagggtggggagtatgcggtctactgagacagcagccgaagcagctaagggagtgctcacaacaccactcccccaccacccacccagcagcaatcacacaacacagagaaacctgtgaatttgggagatggagagcacagggactggaggactttacattaaactcagtgctgccatgtcagtaaagacctggcagaattctcacctgctgactaaagaaccactgtacccagaataaaaaacagtgacaaccaggtaatacaccatgggcattgggctctgagaagtgctaacttcaggtgagacccagtgcatttctagccggggtagctatggtgaaagacttctgtttgagaaaagcaggggggaaagtaaagggaactctgcattgcgcctgatataccagctcaaccacagtgggatagagcaccaagcagattcttagagtccctgactccaggcctagggtcttggtcagcatttctgcacttgccctgggccaaaggtcgagtccctggcattgcagtatttatcacaagctaactaaagagtccttgggctttaagtgagaaagtgatgattttgtggaaccctcccatgggccagtagtggtggtagtcatagaaaaggctcttctgcctgcagacaggggaaggaagagtagaaaataatttgtcttattccttaagtgtcaggttagctacagtaaaatagaagagcaggtaaattttgaagattttatgctttaatctgtggctcccaggtagcatctgtggaaccattcatgtctaggggaacttgtcaccctataggcagagacacaaacctggctggctttgccacctattaatcacagagtcctagggctttgaagaaacttatatggtagccaagtagtggttgcagtgggccttgggtgagaccaagttctgtgcctacttcaggtgcaaaccagcacagtctcagtggttgtggccacaggggtgcttatgttaccccaaccccagctccacatgtctcagcacagaaagagagactgctgatttgagagaaagtaagggaagagaacaagagtctctacttgataaatcaagagaatttttcttgatgttaatccaaggccaccaagacattacctctacgtgtttgcataaactactgtgctattgggtttggaacccaagtttctttgaatacctggaaagtgttcctaaagataatgggcactaacaagcccagactgtgaagactacagtaaagactgaactcttcaatgtgtagatacagatgaacatctacaagtatcaaggtcatccaggaaaacatgacctcaccaaagaagccaaataaagcactagg

SEQ ID NO: 191 - DNA, 1600 bp, Artificial Sequence
  Description of Artificial Sequence: Synthetic polynucleotide
gcgctctgtgtgcagtcaaatactctctccttttcattcccacttattatagggagacttaaagaattatttgaggttgtttgaataatgagaatgagactaagagcatttattctgtagctgcaacaggcttttcctaattcttaggtctttggtaaatcttttataggaccaagtggcttttaacatttgaagtggtggcttagaatttgaaatacttgcaatattagtaatttatgaaagctatagctgggttagctcttacctaactttttatttaagaatagtaataatcagataaatttcattcatggctcctgctaggtgaatttatattaggctgaaattaaatgggcttaataaggtgaatgccaatatcacataatgagatgttctctttaactaatttctaggatattattagaatactataaaaacatttccagaatccaactttaggaagtaatagcatagaaactgagtatttatttatggactgagtttagactaggtttattaaaatggatataaagatggatacaatatagttccttgccttcaagaagcttgatttgagaggaagaagcagtgcaaagccctatatcatgcctctgataagagaagcattgggtgctggggggcccctaagagagatgcttaaacaaaattgagtaaggaattgagataggaactggtttccgaaaatgtaatttaaaaggagagttggaatttaggtagaactcaagaacttaatctgtacagacagaacacgtataagacattttggcagaatggagtattacttattacagaaaattgcaagggttcagtgtgcttcagggcaattattagagttaaggctaaagaggcaagtgaaagacaaattcaactaagtcagtaataatgtctacttaatttatggttacttacatcatattcgttattagtgcaatgccaacagatatttttgtagttttatggtagtagaaaaatctgtgtcattcctgacatagacaataatgataactccaatgtaatgtctattttgaaggtaataaatgcaattgattagaattattcagacctggattcctgattgtgagggaaggaagaaaagagtaaactaaaatggtttattatctcatctagagaattccagttagctgagtggacttgagggatgatgtcctcttttctgtaagttgtataggggaagtacaatttacttaaaatactgatatccctcagtaaaaattttttaaggttttattagctactgttttggcttctaaatcttagtaagactgtcatatattaacgtgcaatgaaagcaagaagtgtattctgcaaagcataggagacttatatagacttgggcatgcttgtttctatttttacctttgtaaaggtaaaaaatagactccgtgactcctgcttttttctgttgtaacaaaattcagctttctctacatagtggctccaaacaaaatcctagaaatgactaaatactacagaaaatatgtcagattttgtttatctaatgcttataaatatataatatagttacaactgaatgtagtcacattgatgttataccatt

SEQ ID NO: 192 - DNA, 1598 bp, Artificial Sequence
  Description of Artificial Sequence: Synthetic polynucleotide
ggatattttggtgacttttaaaatttattataaagacatgttatgtcctaaaggcaaatatgctgactctaatccatagtttccaacttttatctgtatcattttttatgaattaagattgttttctttttctcttaaagaaattgaattcccctacattgtcggtgaatagtgacggatttatacctatgctggccaagttagatgattgtataacatatatctcatctcatgtaagtcagagtatttttgcatgttttaaagaaatccttagattcctattcctgttcctatctttttgtgtttttcaacttttctgtgtttagcagatgttcctattatatcacttcttgtgctgtaaagtgattatttctgtccaagggaaaaatatgtatttgtaacatattaaagaaaagttgtagtgaattcttagtcgttattagcagtggtgtaaaaagtacttttagctcctgcaatagcccctggaatggaacacatcctggctgactcagctttatcccatctaacaggatgagctgtttttaaattgttggtgtcttgacatgcccggtatttctttggaaacagaaagtgttacttggggggaaataaagggacaagccctttgatttaatcaccctctatttctgtttcttcaggatttattgctgtgtttatttcccctaactcctattcttttcctagttgggtcttacatattagccttgaagtctgtggggtgctgaaaatatcttttactaacaactgcaaatatgtatggagctcctactttgtgccaggcacagggggtttgactgtgactaagacagtcacagtatttattcatcttcatggagtttatgatctttatgaaacctgtttttgaactttatatattgctttacataggaacaccttggttttcactaaaagcttgctttttatctgtgttcatttccactttgtaaatctttctcttttccttacagcctaattttaaagattatcccatatatttgctgaagtttaaacagtgtctttctaaagctttgcacctcatgaagacatatactgtgaacacactacagaccctcacaagtcagttactgaaaagggtgagttaactgatctcaacaacaggtttttgttattgttgttgttttgattcattcatcttccataatctttggctgagattagtactttgtaattccaaaaaattttaaccttttgttaagaatatgtactacagctttttatttatagtagggaaaaatgactatgttataaatatcccttgcaaatgttattttcaaataatgtttaatagtgtgagaagtattcagtactatatgatgaataatcagatacaaattatttgtctcttaaaacattccttttctatctttttcatgaaaatattagaaggaaatataccaaaatcataaaagtggctgtgtctgagtggtgggttaatgtgcttttgaagcatattcatattcatatgcaaaattatgcatctcataatgcataatttaaattttcttctttaccctttttttgtatttttcaacttttctatatttagcaaacatttt

SEQ ID NO: 193 - DNA, 1597 bp, Artificial Sequence
  Description of Artificial Sequence: Synthetic polynucleotide
gttccagctactcgggaagctgaggtgggaggaatacttgagcctggaagtttcaagtgagctgctatcgcaccattgccctccaacctggcctacagatgagaccccatctcaaaaaataaaataaagaatagcaaaacgagtggaaataaaaaccagcatggaagctgaagtatgagaagtcttcatgatgtagataactctgagcaatttattttggtccacacctctcaaatgtcatgataggtggatcagttaaatactgcacatccctgtgtttgtcaaagctcttagttgcaagctgaaggagttaccactggctgatttaagcaggcaaaaggaatttattgaaaatattgtgtttatttcagattcaccaggataactgaagtactagtttcaagcctagccatgcaccttgttcattgcaacatgacagccctgtagaagtcatgcagtcagaagaaacatactaaacatgctgcacaattggtctggggaagacaccattggcactgcaccaaacacagcattgcatcacaagcccagctggcacccaatactggctgccaccattgttactgcagtttctcatctccctgcagcactgcagctggagagttcctcaagagtcctaaactacaaggaagtctaggaaagtaaggactggacatttttagtgtttgtaataagaggcatctcaagcacctaacaagatgcaaaatgagggcaggggagattccccaccgaaaaaaagattcaggtgatgaggaaccacaacggaaagataaatggattctaccattccatatccaaagcttacagtaaacttactttcaagcactggaattcaccatgaattcccaaaattagaatgcgtactcatgtagctaatgaccttctgtgtccaatcacttttaaattcgaattaaagcaggtaacaaaatattgaagctattgaggttaaatatgtcctcctcaatttctaaattaaatgaaaacatcttgaggaatttttaatgatgaatttccttactcagattgccaaatgacatgatcaacagagaaaagcctggttttgtttctccatcacactgccctattagattgaattagagccatattaactacttgtcaaaatggtaaaagataatcttatttggaagcaatcaaataactagagtttgggtagatataaaatgtcactataataaaggaagtatggaaatcctagaccttgggctatcaaagtctgctacttaaaatagccattcaactaatattttgcctttttccatatcagaaaactggctaatcactgggaatttttttttcctgcttaagaaggaattcctgaaggaatgtatattctatggagggttgaaaggatactgatatgtaaaaaatgattataataattataagatatagcgggtgccctaacagatgtgttatggtttgaattgtattccacccaagattcatgtgctgaaattctaactcctggtgcttcagaatgtgaccttatttggaagtaggaccatagcagatgtcactaattaaattaaaatgagatcttatgcgctctgtgtgcagc

SEQ ID NO: 194 - DNA, 1590 bp, Artificial Sequence
  Description of Artificial Sequence: Synthetic polynucleotide
acatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctccctgcaggaggctgcatgtaagctggctattgaatgtggctctgagctgagacctctccttgaagctccagaccaggagccagctgctagctggacccctccatttggtgcctcagagaaaccttgcactccatagatctgactctgaaccccgaatatcccatctcagccctgtctcttcatagggaaagcaccacctctgacccagttctgcaccaaacccacacttgagtgatggggctcctgccctgcactgtgagcactctggataagccagagctgagggggaaagagctctgaatgccaagccaaaacatgagtttcaactccacctccagctctgagagctgtgggtagggaagggcccaagtccagtttgctgtagaaagaccagtctgccactgtatggcacatggatggcacgggcagagtgcaggtggagagaatagtaggtgggcagggtgggggaggcagggacatggctgtagccgtggagatgggaggacagacaggacttggtggccacttatatgaaccaagtgaggggtcaggaagagatacccagttttgtatcagatgtgtagagcgtgggatgctgttcattgattgagggaggaggaggaggaagaggtatggcatgggaggaggtagctgagctctgtcatgaatgtcatttgaagtccccagggagagccaggccggcca

SEQ ID NO: 195 - DNA, 1588 bp, Artificial Sequence
  Description of Artificial Sequence: Synthetic polynucleotide
ctcgggaggctgaggcaggagaatcgcttgaatctgggaggcggaggttgcagtgagccgagatcgcgctactgcactccagcctggtgacagagtgagactcctcaaaaaaagaaaatgaaagaaaaagaaagcagcattctgtgtttctgtgggcacgacctgtgggctcatgcgctcaggaggctctagaggcactgacactcatctccgcccatgcctcctctggcctcatggacggtggcaaagtggaaacaattttaatcaaggtctgtatttttaacaaaaaatgtattaatgacttcggattcttaagacttgtgatttttcacctttacactggtgtgaccgcaatatgcactcggtagaacatgaacttcagatttggtgatatgcaatacaatgatcccttcagatgctgggcagtggcgtgagcacagctctcggccaacatatgactgcaggccaaacagctgctactccaggacgctgtggcactggctgattctgcccaactgtaggtgaaagtgagtgctccaagcgcgcttaagcgggctgggctcagctgtgatgcttgctagattgggtggattaaatgcactctcaactcaccttattttcaacatatgatgagtttatcaggatgtaaccccctcaaagttgaggagcacctgtacagtaaatgaaaatataatgaggaaaagattctcctgctcagtcgctgtttactgaggtatgatctggggcgggaaactgggcttcagccctccaccacggccacccagagggccctccttgagcatagagaggggcttctcatcgggaaaggcaggggagacttcccgggtgacgctgagcagaaaccaataggcaggcaagacacaggcaggggtggcacgggaaggagagaggtggtcccagccgagggggagcgcaggaaaaccccagagatggaggaaaccaacgtgccctgcctcctgccctggatggagaggcccaggccctgaccaccaaggcaacaaaggcctggcccagcgcgtgcggccagaacttccacccctgtgcatctgtgagggatggaatctggagcaggacctttacaggaacccctgttcctctcaggaagggacttggggcttcctaggttgtctacaatccccagagcatccctttctcatgactgccatggccccacttggcacaggcctcagcctccttcccggtgctctgcggcctttcagccccttctccccttctgggccccctccagacttcagtgggtctggagacaataagaatttcctaattccaggctgcgggtgatggatgcagcccaccaggcccctgccacggggtcttcaggaagccatctcccttctccttggactctgtaattaaagctggggataacctactgtatttcctaattagcagccttaatccctcatgcacaccattaacaggctggcgcatctttagatgtgattggtaatgtcgttagcctaatccataatcaatccttggataattgcttccttgggtttatatttagtccttgggggcgctctgtgtgcagctgcacacagag

SEQ ID NO: 196 - DNA, 1585 bp, Artificial Sequence
  Description of Artificial Sequence: Synthetic polynucleotide
atagaaaatgagggagagccaagagaaatttggtgctggtggtgactgctgaactttcaggatcattaaaatatactgctaactgcatgaaataagcacatttgactcaagtttctccttggggatggtattggtcagtttctcaggagagaagccctcttcctctcccttaccaaagactctgtctccagttaaacagggagctgcttctttggttattagtggctgccccaccttggtgcatccttggtgtttagcactgatcaccttatgtaccaacatcttcctactagaaccctgagattcttcctgagcttttcctggacttgggagcatgttggcctgggcacatgcaagttgtaaattcttgggagttaatgtagaagcaatggcctgtagccattggtagatgatagataggaactgatgggtaaatacacagccacaccctgccaccatgagggagaaccatcaggtgtattccatgtagttccttatagttccccagtgggattggggcccagttgaccatagaaggaacttcctcctttgcccaaccttttactggattccttcccttcccttacttcctcactcccctagccgtgctttctgggaatatctcccaactagactctgcacatgaatccttgtctcatagtctgcactgggggagcccaaatcaagatgatggtcttcatctttgtacttgctaggtcttcctttgagagctaagcctgaagagtaaagcctcttttgctgatcagatgagtaggttattactggttggcccatttgcagaaggaaccacccaagagcagatgagagaactgagttccaaggcatgtttctgcagagacaaggtagagaggagcagagaattgggcgctgatcagcagcggagtggacgaagggtgaaactttactaacctggagcagaggtctaagcccacaggacactggccaggagagtcttgtttctctgcatacttggcaaggcacttcatcttcttctgtcttctctttaccctccatgtatgagctgatgactctaacatgtctagttctacctctacacaaacacctaagagatgctgacagcactcctcacaataagtgacaattcctgcacctgacacccttggtggacctcaaactcagcatgtcctgaaccaagttcattattttccctccataatcctccttttcaccccaccacaaaacactgaatattttccatcttcagcattacttcctttagctaaaagcaagctctgcacttctaagctatttgctgttcctatcttccacatctgactcctcaccaaaactgctccattctgtcctgtgaatacttcccgaatgaggcttctcctccccatcactggtttcatgttcccatcatccctcatcgcacctgttcagtcatctcatgactccttgcactctcccccttcatttatccctccattttgcaaccagagcagtcttcctgaatggtgaatctgaccatgtcatccctaccaccaaaacctccattacttacaaataaaggtttaaatcattttttctggcattcaaggct

SEQ ID NO: 197 - DNA, 1585 bp, Artificial Sequence
  Description of Artificial Sequence: Synthetic polynucleotide
aattcatcattttttgcacagccaattatttcaatctttgttgcaatttttgaagtttatgaaacctacacttattactttttctatttatccattttttccaaatgaataaggacgaatgcaataaaatattcagataatgaagtacaaaaccgtgaacaatgacaaacagactggttggctgtcaggcagtgccaacatagctcaaaattcttgtttttcagataatacgtgaggtataagtttagagtgccactagaaagagcttatggatatcaatgcataataatgcaaaataagaaaatactttatgaaaaataaaactgtaaaatttagggtccatctataatttttaaaaccacccttccaatgaagcatataatctgtctccttaaaggtgacaagatcacttcacagaacaacctagaaaataaagagattacaaacatattcttctaaatatagaaactgtggttattttgaattattaaagctaaaaatacatccatgtatatatatggcctttccgaagtaactgcaaaaaatggggaatatgctctgctcatctggagttaatcttaaacatgaagaaattggttcatgataggatcttgtggagtagttactgcaccatcatggagactcttacaggagatgaaaggcgcagaagtaattttcagatatctagaataggctttaaaaatacaaagttccaatgattcaataaaagacctccaagaattaggagttctcggattttgagttctacaaagttgggccagagaaccatgatccacttttatatgagaaccgttttatatggcacagctacataaacaaaatttatttccccttctattttttgaactatatcttacctaatcaccaagctctcctgaatttattgtgtgtaaggcctgcaggtacatgaattctgtaacaaaatgcctggctcccttctctttaccttctcccagttctaaagtgattaagaccatgaaattggctggaatatataaaaataacttcacttaaactacctaagtttttcttgtattgctgctaccatccctaatatatctggctttcttgccaatttatcacaatctgtaatagtaatccatgtggctaaaggcaaagtggatggagagaactagattagtacaaacattatctaagatagataaaagtattaggtaacagattgactttgggtatgagagaaagaagaatgaatataaaagaatataagataaagtaatagtattgtttaagggcataataaatactttttactcatctacattttgttatatagaattggatgtcctaacatcatattaaggtcaatgtacccatttaattacagacttctcctctaatcatttcacaattttcttagtttgttttgtgctgctctaacagactatctgagactggataatttataagcaacagaaacgtattggctcacagttctgaaggctgtacatgaaacatagtgacttcttctggggaggcctcaggaaatttacaatcatagtggaagatgaagggggagctagtacttttatatggtccaagc

SEQ ID NO: 198 - DNA, 1583 bp, Artificial Sequence
  Description of Artificial Sequence: Synthetic polynucleotide
tctctctctctctctctcccccctatactctgttgtgctattgagctgacattggttattaaagatgctctcctttcttcactgatacacagttgctaatctctttcacagatagttttcataacctgtaggtgtttttatctagacacttgtttttctctaatttattctgatccattgctctgtttgtacatctctataccacacttacactgtcttattatacttttacattaggtctaattgagtttggcaagaattccactttttattttgtctaggaatgtctttggctatttttggtcctttgttccttgatataaaacttaaaatcattttataagttccacaaaaagatgctgttcagctttactggcaattgaattggatcttttgatcagtttggggaaaaactggtgtttttctgacattattaaatcttcctggaacatggaatatttatccatttacttaattattctttaagttttttcaataaagctcaaattttctcaaaatgatcttgcccgtatttagttagacttaccctttggagctttgactacttattctacttttaaaatttcttttattttcgtctctgtgactaattgaacttcttactcaccctaccccaatttttttcctccttttctagtttgtaagttatgtcctctatttcaactgcatcagtatttattccagaatttattgcaggcatacttgataaaatctaaatattatctctatttttgattttctactaaatattatataaaacatagaatgcttgaacttgaataactttcctcctaatttatagtatatctttatcaaatagttttggtcaattttgttcatttttaaccttacaaacgggtattatttatactgttttatagcaacaatattgttgatatgtttaccattttctttgatcaccatcttttccttgcttctaggatcaagtgagttatgaagacaaagaagtgctgtagcttttgcttcatttgttcactcatttattttacaaatatatttttataacgtattgggtcaggcactgtgctagatgctagaaaataaattaggagcaaacagcccaagtcttcttctaacttgcattctggtggaagaagagacactaatcacacaaatacaacattacactgtgatgaggctctctgatggaatggtaccagagttatgggagtaaatgactggggttggggatctcacttggtctgggactcagaaacaagttagattaatatgaaagaggaaggtcttacctaagtaaacaggacaatagtgggaaaaaaattggggccaattccaaccaaacaaacaacattccaaaatcctatataagaaaagaaaaacatggagtatttggaaaacaaaaagaaagccccatgggtggcacatatatggaagggggaaaggaccacacaggaaggatgagacaatcctacgtctaaacttagatctgggccgggtacggtggctcacgccagtaatcccagcactttgggaggccgaggcgggcagatcacctgaggttagggcgctctgtgtgcagc

SEQ ID NO: 199 - DNA, 1582 bp, Artificial Sequence
  Description of Artificial Sequence: Synthetic polynucleotide
ttccttaggataaatttccaggagtaagattaccagtccaaaggtataacagttttatgtctcccattaaatattactcttatttctcaaaagggttttccctgtttgcactaatagtaatgtgtgaatgtgccaattttatcagtatcaagtattagctttctaacattgtttttctgattttagtaggtataaagtgtgttttgcagttctttggttaacatattaatggaacatttttcctaatattttttgcccatttatctatggggacttttgaagttactcttttatttgaatgagctcttcatctgatggtagatggtgaaccttcttggtcacatttagtacaactagcttttctcattctgatgaaatgtcttatttttcattcaatagaaattttacctttttctttagttgaatctgtcaatattttcttttgtcttttttttaagagaaaccttttaaaacatcgaaattaccaatattttaaataccaaggaggcagtgtgatgtgatggcctaccagatcttgaccttacgaaggacaagttgaaaagatgagtttcaaagtgctcaggagtgtgtgtgaggtggaaatgtcaaccccagcgctgcgtgtgcggccacacactgtgcatagccctcccacgatcattgtcccgccgcctgccttgtgtcctactgtggggttctccttagtcccctttgtgctgaatcgggcagttctttcctgggagctcgtgtggtgtgcaaagggttgacttaaagtagaattggaactttcatcacgacaccaactgcattattatttgagtagtgattgagttagtagaaatcaccaggagaaagaccatcttttcgtgttaattttgcgttcaattttgaattgacaacaaaaaagtgaactcttttaatacgtttgctaaaccttgtcataaggtcagtagacccttaggaagcattttcttctctgcctataagacacatacacatggatgtggagccagtagaaagagtagcttccatacaaactacttagtgagtatcgccagtttcgttttgaagcacaatgcattggacctacccaggacctgtcaatctccatctttgccaaacaaatataatacagataccgaagacatatcgtgcagaactgacctcctttagaaatctacttttttttctttttagaatatatttctgtttcagatctgcatattttacttgttaaggtatttaacaatattttacattttctttcagtcttcacagaaaagtactgtacagctaaccatgtggataagcttcctggcccaagagattgggtacagattctacaggatcaaattaaactggccagaagaaggttaaaaagaggctcaggtatgactaaggtgcagaaaaataattggagaagcacttatgaattcttagactttataaagtacaatacttggctctaggttatttcagcatcttgtcttttgaaggagagactgtttataatatgctgatttgctctcttaaagtcttattcaaatgaattttgaaactcaccttcagactaaatagtaaa

SEQ ID NO: 200 - DNA, 1579 bp, Artificial Sequence
  Description of Artificial Sequence: Synthetic polynucleotide
caattttatagggttattaaaaataatgaaataatcaccttgaacgaggggctggccctaggccaaacttgttatcaaagcttatctttgcagctattctcaatttcatgtctccattttcaacagctctttgctgtcctagttcttaatgataatctttatattattcaaaactcagagttggaaagagccttgaaagttctttaagaatattccctcattaattgattaagaaaatgaggccaaagcaacccaattgacatatatatcttagatcaattgactagttaatggaaaaggacaagattgaaattaaaacaattccttaaggaaaaaaaaatcacagcttcatctaatacacaggagcatcaaacaaaatcctttctggataatcctggcagaggttttgcctcagtgtccagaccaagtgttccctgatagacctaacacacctgagcctggttttccccaacatgtcctcataagtttcctgtcctttcattctcaagttgatgaataagtaataacatataccataaaatgagcaataagtaaacatgtcatccctcacacagtcaatatttatattttaattaggctttctgtgtacacagatatttaataaaaaaggaaaacatctccactgccatttcagggaatttgataaacatacaaagagcattttgagaaggctagctactcagtagctctcaattcatgactatcaggaagataacaactgaggctactgcaataactaatgaggcgatgcattcagcctgcttacaagaaaaggttacagctgtgttccagtgaacaagtaacaattattcacacagcacaactaaaactgtacagtttaccatccttaatcactggtgcctatgttgctttgtgaagactggtttgttctctttacataagatgcggatttctgagagtcaaatactgaattttaaaagacctgagtcaaaaaaacaacatgtcagtacaattaaatcctactcatgactctaacagagaatagaaatcatcatccattgttgcctagtctcttggctatttcaattttatttccattccatcatttgaaccatcaaaaagtgattctgcacaatacccttattttgtcgcttatcaaattgtcacgattgcaattgtctgtttctttgattatactttcccaacaactgtgagctgtttgaggactggcacaaggttgattaactatttatctccagtttctagcacagcacccagaacagagtaggagctcttcaaaacttttctgcttaataatctacaataattattttggtaaataagaaaaaattatatattcacacagtgaaacttgcaataatgatcaaagaagccagctttccttatttattaatgctgttctgattttatgttggcttctaattcctttataacatacatttttaaaataccaagtttctacttaagttggaaatattcccatccccattcgacagaataatttaagtttagtgattcacttgtttacacttaccaaaaatagacatgccaatttatcaggcgctctgtgtgcagc

SEQ ID NO: 201 - DNA, 1578 bp, Artificial Sequence
  Description of Artificial Sequence: Synthetic polynucleotide
atacaaatggccaacagttatatgaaaatattatcactgtcattaatgattagaacaatgcaaatcaaaaccacaatgaaatattattttattccatttatgatgactgtcattaaaaaggcaaaaagtaataaacgctaccggggatgaagactaaacggaactcttatactctgtttacggttatgttaattagtacagccactatggaaaaaagaccacttttatatgaaatggtatcactttttaattgctatataattgacatataataaaatgtatacatttttaggtacatttttatgaggcttgacaaatgatacacccatataactgccatctcaataaaaggagagaatgtttgcatctttccagaaagttccctatgctccttccatcaatccctgtctcaccagccagcatcaacccagtgcagtagtggttgtgatttctgttactatagaatagatttattatttctagaatttcatatgtatgtgtgatttttttccctcataataatattctcactattcaaaaatgttgagtttatatcagtagtttattccttgcattgcctagtagtattccattcagaatatagcacaatttgtttatccattctcccatttatgtatatgtgttttttctggtatagtctgttattaaaaagctgctaggaatattcttgaacaagtcatttggtgaaaatgagtttttatctcttttagataaatgcctaaaattgactgctgaggggtgaattgtggagatctgttcaaagatttaagttgtatctgctcactgtgatatctccagtgtctgcagcagcacctggccaataacagatgcctacaaacattagttgaaagaacagatggttaaacaaccttcattgatcatttattctgagtgatgtgatatccttagaacaaataacaatacatattgtcctagcagtacatatggattccaggcaaaagagtgttcatttttattattttgtcggagtgtgcaatggggaaaactttggtgggaaatgtcgataatgagggaggctgtgtatgtgtgagggcagggaatatatggaaaccctctggacttttctctcacatttgctaaaatatataattgttctaaaataactaagtctgagaaaaaataatggggtaacctttccttggcagaagacgagtattttggttgtggtggcttcccaccgcgaggagcagcttcaatttaccttgtgccccaccttgcttcccctccaacccctatatctacttttggaatcttcctggaggttacaacccacttgaagagctctgtttgagattttagccttggttgaattaaggaattttagactgagagcttaatttctctaacctccattaaagccttaactaactgccttgtggcttattccttctctaagtagttgcagcttcttattgtgagattattttaggcttccacagaaaaaataaacaagaaaacatagtttcaagggacctttttgtgtgtgtgtgtttctttagaattacaatctcctaggcttcactggattttgccatg

SEQ ID NO: 202 - DNA, 1574 bp, Artificial Sequence
  Description of Artificial Sequence: Synthetic polynucleotide
gaggagtagaattttatttctctttttttttgagagataggctctctgttggccaggctggggtgcagtggtgtgatcatcactcactgcactgtcaaactcctgtgtttgagcaatccttcagcctcagcttccagagtagccaggactacaggcatccagcattatgcctgtatttttttattatttttgaagagagagggtcttgcattttgtttatacttttagacctagcaacaagagtggttctagatctataaggtgaactttgtaatataattttattaattcataagttattacagtggaagaatatttctactgtgattactccttctcccaccataaacagtataaaacaaactacgtcttatctaaaatacatataagacacatggacacacaaaagagtgaattcccagattcttgttcttttgaccctgggctgatgctttgacttgaggaaatatgtgccattacaggggttggtgtcctttgaagatgtggctctgcacttcacctgggaggagtgacaggacctggatgatgctcagaggaccttctacagggacgtgattgtggagacctacagcagccaggtatcattgggtgagtgaaacttcccagtaactcccaagaatgtgtattgttgttggtaaatatagaaacccttttaagatataataatatttacttgtaagattctggttgatgaaaaatgtgtcattattctaatgaaatgttcaaattggctccttcattacacagtccctgaagcccagctcttgtcattctgaaaaggatttgacttagtggtttgacaaagtattccattgtttctcgttaccagggcattgcattaccaaacctgagatgatcttcaagctagagcaaggaacagagacatggatagtagaagaaataccaaacctgagactttcaggtcagtcagtgaatactggggtgggaggcctggaggagtaatgcccagcagattttggtagtgttatcttgttttcaccacttttttccctaggtcttcgacctgaagactgttggtctgcattaaatgtccattatatagtccccaggggtaactgtcatgcatatatcccagtctcttatttttctgagtatcttcttctatttaccccaaatccaatccctgccatcctctctttaggcctttttctttgctatttattttatctatttcccccttttcctctattctgatgtagtgtcttaaaaatttttttagacatttatgcatttatttatcctttgaatgtatcttaagcaatttttgagaatcagtcattataacaatgatgatgaaaatagtgtttctttttaagctgtagctttattcttcttgttttattttttatcaaacagatggttctcactctgtttctcagactcaagtgcagtggcatgattatagttgactgtaacgatgaactcctgggatcaagtgttcctcacagcctagcctcccaagtagctaggactacaggtgtgtgccaccacacctggctaattttttattgtttgtggagatgaggtcttgt

SEQ ID NO: 203 - DNA, 15851 bp, Artificial Sequence
  Description of Artificial Sequence: Synthetic polynucleotide
gtactggatcagatgctcttccacctaggggcaggcccagggctggcagtcaggccccagcagcacccttcatgttctgcctttgggtgcaggaagagactgacccttttagggcctcagcttccattggtggaaaatggggaccataagttctggttcccagaggagttgtgaggaagaaaggggatattttattttattttgagacagagtctctcgctctgttgcccaggctggagtgcagtggtgtgatctcggctcactgcaacctctgcctcccagattcaagcgattctcctgcctcagcctcctgagtagctgggactacaggtgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagtaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatggctccgggcctcagggcgggagtgcaggtagaggatcctgcctgtgtccactgcctcttgggagaagctctgcacggggtccaggctgggtggctcatctgccaagatgccacgcagcaccatcaccaggtagccggcactcggtgggctcttcactgagaaaacgatgtctgctggcggcactgcctcctgggctacctggttaacagaggtcatgaggactcacaagggaatgcgcagaggggtctcagaggggcccactgtggccctaagcagccagaacagccttgatcttgctccacttatttccccagataccactgctcatttagtgacacacacacatgtgggttcacacacacagcagccagacatgcagctggtcacattttttgtttttttgagacagggtctcactctgtcacccaggctggagtgctgtggtgtgatcacagctccctgcagcctcaacgtcctaggctcaagggctcagcctcccaagtagctgggaccacagtcatgtgccaccatgcctggctaatttttaaatgttttgtgtagagatggggtttcactgggttgccccagctggtcacatgttaatacccaccccacacatggttacggggtgtcggtcaacagcttgagatgcactccctcagggaggtgcataatcacatgtccccagactcagtgacacagacatatgagttcatcagatgctgacgcagtcacacaggtacaggtacacatgcgtgtgtgcacacgcacacaggccccctgctcaggatctgttcaggcctgtggctggtttgctggcagcatcctccccaacccctgctattaccacccaggaccatcagagggcgccccgccccacccctcctggaggcacagccgccttcagctcaggccctacagagctcacgccccaaaggccacacgggctccctcacctgacgggccagccacaagaggccaaaccacccccaaactcacattcctgttctatgcctttgcccggaatgttccttctgcctggaataccactccccattctctgctcctgatggcctgtgctcttcagagcccggcccaaacgctgcctcctcccgcgaggccttcctgactccagatctgctggcttgctgtcggccccaagctccagacatgcagaccagaagggtctccgaaatgagcagtgtaggagagtaaggccaagagcgggcaaggactggcctgaggtcacagggcatgtcagatctctggaaggcccgtggctgctctgtgaggttcctgggtaagcagaagcccttgacagaccctcctggtcctggtctgggctctgagaagagagcaggctacacaggggtctgagaggcagcggcctgtctccacggccagcaatcccaaaagttcaggacccgtgatgccctcccagggaactgactgcaatgcagattctcgggctccacttcagagattctgtagggctgggtggcgtccaggaatctgcatgctcagccatgccatggacatgagtgggcaccagctctagaggcacacaccactcccaggaggatgggtgtacagcaagctccccagaaactcttgggaacacaacatatatgggagcacatctgaggcacgtgcacacacgcaagctgggaccaccacaggtacagcccaagtcacatgtgttcccggcatggaggctgggaggaaggccctctacctggtccacaccccgctcaccacctccagctcctcacctccagctggtcccttctgatctcagctgcctctccctggaagatgtagatctccttgtgctgggccagcttcagtggggctactgggccctctagggcaatggtcacttgtagggtggcatctgtgtgcactggtcccacatccattgagaaggccagggtgttgcgggagctgaggctgccattgtggccatagagaacagccccaaccagcaggtcctgctgagagaaggctgtggctggctgagtggcttggagcaactgtccccagtgagggctgtctgtgacgtggtagtgggcctcatccctactgcagatgttgaggttggtgcccaggtggagctcggccatgttgatggtaccctggcctccttgaggaaccatgaggccggagccattggccacacagaggtaaggctccaaggcctgcacctccagcaccgtgatggcctggtgctgcccatcggacacctgcagcgggatccagccgtggtcagcctgagtgtgtgaacaggactcgcctcttcctgaggcccctcctggatgaagcggcagatgggctgcatgggctcatccgtggccatgatactgccagagaggaggtcctggtgggtcagcaccagctgggcctcagcaaagcccgaatcagcattgctgaaggccatgttgtctgtagtcagcagccgccacctaccccaggccacgtggaagacgcagctgatggtctgcataggggcgtggtcattcacaggctggatggccactcagaagacaccccatacctcctcccaggccacgtcaccactgctctggtcctggtggcagcaggaaatgggatatcatcttctgtgatctcggagtcatcatgctgctagaccagctggccatgcatcaggtctccattggtgaaggatgtcaccatagtgatcttgtcctgtgtcccacaccaagtcaacctcccatggcggggctgctccatgacctcatagaggtacctggcactgttgagactcttgatgaagagctggtcagcagagaggacacactcaccaccctcgggcaccatgaggacaggcatgtctgggtcaccgccaatatggatggagaaggtacagagtggggagaaatatggtggagctgtgacatggaaacagaaggtgtcctccactgccactgaggcacgtgccatggccccataggtcacctctgcagcctgtacgtcatcctgggtgaagccctgaccgtctgacagcatcatgccctgtagttgaaagttgcctttcctgggagcctgaaccacctcacagtggaaggttggggggcttgggcctgcctcctccagggtggcctccaggtgggctgtggtgagggcctcctgctgggtgttctgagtgtgcagtggctccagctgcagcatccacacagtggctctctggatggtcactaggaaggacagattgctcaggatttcccagctcacctgcacctgcagatccaggttctccacggtgtcctcggtgtagtgctgtgggtcagtgctcaggtatctcacatggccctgatccacatcctgctggtggaacgcctgtgtgacccaccactcagcatcctccaccccaccagccccctgcttctgcagctccctgaacggcaggcctccggtgacatggaacagcacggtcacatcctgccccacggcgctggtctccaccaacaggttggtaggcaagatgggcatggcagagccctgggccagatgcagccctgtgctgcggtggatttgtatggccagctggacagccaccaccttcagcatggccggggggctggcctgcagtccattgctgacccggaatgtcaagtcctgtgtagggccaccacagtggacatagactaggctgccggcctccaactcccagcaggagaactcagtcaccggctccccaggctggtctcggtgctccacggggaggccagagggggtgccaaggagctggaaggcgaggccctcacaggcagagtccaggtcataggcctggagaacctcaggccccagaggcttctgtgtgtgttccaggatcaccataaggctgccatgtgggaagatgatgtggggtgggtcattgacagggttgacctggatgggcaggaggtctgtttggcccctccgcaggcatgagggcataggcacccaagccatcactgacacctccagcaccagctggtcagaggtgtcctcagggccatcgtggatgaagcgggccttgcagttcaccacgtccaggagggtgaacatttttcatgcctgggcacccaggacatccagctcgagctcgctgtagtgtgcccctcaggtcacgctgaacagcacctgggatttacgcagttcagcctccatcagtgccagcatgggctgcacatgccaccactcaagccaggctgtgccaccctcggtcaccaccactgcgctgatagcagctggatgaaattggcaaagacaggaggtagccctggctcaggcacgcatggctcagctagctccacggacagccaagccttgggagccagggtggagaaagcttcataatggccataggcattgtctacctcctccagtctgcagccagccaccatgttgtgcgtcagcaaggcttcccacagcccccgcctctagccattgacactgaggtcttccatgcagccagcccagcagggaggcattggcagcccctggtgtcaggcctgagcggtgttcctggaggtgatgagaggcctctgcaaccagctccccaagaaggagactgtcacgtggctccaggtagctgaggactcctcggttcaaagtacatgtggggtactggtccatggagatttctagctggtgaatgttgatgtggatgctgaccttgtggggctgtgcgtcagtcacaggcacactgttgaggagcaatacagtaccctggcccttctcaaccatggaccacaggtggccctcaaatatgtccacatggatgaagtccccatgccagcctgctgcctggaaggccaagggtgcctgccagctctgtgtggtgagtgtaaactccagggttccttcatcctgagtgccccaggcaggcaaggcagccagagagtgggacccagagaagcccagggccacatcgtcattggcagaaaactcttcagcacagccctcatgcttattgggggtcagaggctggaggagtctgcggccattgagagcggctgcatggaggcaacccctcaggggatggctggttcccctcaggtagggcaggccaagtctcccagtgctcccaacaaagagcccataggggacttctaggggggctcccaggactacagaggaggcattcagaaacccattgactgacaatgtgggccagtcctctgagacagtcagaactgtggtgtgggggacggagccactcagtagaatttctgctggggtctgcagcctcagctcctcctggcccaggacaagcctgacctgaggagagacggggaatgggagatggggggcagcactttgaatccatcatttcccttataaaagcacagtgggttccccacagggggccccagagcagaaaacctaggacaagggcctctggtgccactcctcttgccttcctgccatctctttattcatcctccaaacactcaccaaaggaaactctgggccaggcctggatgggctctggggaccctggtgtgaatcagatgtggtccttgcccacaaggaactgacatatagcaagatgctcttctagaaacccaacctgtatttttaaattctcctcctctttccttgagtgaaaagcaccagaaatattgtcttggaatctagatttcacccctggaataatgggtaactgagaatccgttgatcagtccccctaagtttggcaaagtttctcgaggtcactgaaggaagccaggctaactgttcagggacagggagcccaggcagatgctctgtgttctggaaaaaaaaaaaaaaaaaagctgcctgacctgtggtggaggaatatctcaaggagagatgaaggacatagttctgtcaccatgacattgacacaagaaatggctctggtatggtgctcccagatgctagaataggtgatggcagagtatgggaactgcagaaccagaacactaagaaccatgatcttggagtcctggtatggtgcatctctgtagggatgtggcatcactacctgcagagctcaacagccatcagcaccagactgcaccacataggtgttcaacagtgacaccttgtggcaatgagcagcaatgacagcagcagactgaccaagccctagtcctcttcccactggggtgtggaaagagatggctgccccaaatttgttaatttgttttttttttccttctaaaatagagatggggtctcattgtgtggctcaggccagtcttgaactcctaggctcaagtgatctttccaccttggtctcccaaagtggtgggattataggcataagccactgcacccagcctgccccaaatttggactaagaccctgggttcttaaactcttcctggtatggggtaagactcaagtaggagccacaagactccttgataataaagcttgtggtgtcttgaaggatgaaatggaaaaatgaagctgaggcagtactggtgctgttactctcatggacagacagtggtgctgcagataaattggtgcagtgccaccaggatgcgcaggggtcatgggggcccaggagggggtctcgccgaggaggaggggatgcccacactgaaacttcaaggagagactagagttcggcaggtacagggaatgggtgggtcacacacctggcaggaggagtgtgatgaccaaaggcctggcagcaagtgaccataagatggccaggaactgaaagcagttcagtgcagtcagagcacaaagggccagtgagggcttgtggtgggaaacatggttggaaggagccggtgggcagagccagttcatgaaggatttaccatttctgagctgctgctgcccatcccacagtggagaacttgagaccccaagaaaagtgacttacacaaggtcaacagccagctggggttcactcaaagctagacaaggaatctcgccccaatcccagggggacgtcactcacctgcaggtgtccagagtagagctgcagcaggaggtggtcagctgggcctgctgccaggagaaggagggcttcgggttgggacatggagaactgcagctgcaggtctatgtcagtcagagccatggccacagtcacctccaggtggttctaaccaaagaaggaagctgtgtgagagagggagctgtggtcaaggctcagattcttgcctggaggaggcgaggtgctgcagggagggatgggtgggttgcagaaaggggtccgtgctggtgcaccctcatggttctgccatacggtgctgcctctgagcactgcccagatcccagcatttccttggtcctggcaccagaaggcacagcctcaccttgtgtccagcccagaccttgacttggcaggaggtcagacccagaaattcccagcaactcaggtctcctccttggaggttcctggagccagaggcctctgccagctctgactcacctcccctgggccccagaggagtctccctcccaggtctggctccccgacctggcccaaagggaaacatcactggcctgatcacctggcttggtggtcacagccctgaggaatggagtttctggagaatcaccaccaggccagatcgatccctgctcagattccttctcctaagtgcccttgtgcttgggctcctgtgcagcacctgccgtgccatgccccacctccatgggttggctggggccacggctgggatctgggggtgatgtcagtgcagcccacctatccctgcttctccctcaggccattcttccagctgccattgagggtgggggcaggagcttattggcctgagtttgccaaggagtaaaggctctcaggccagatggggaccatatgcagtgtcaaaccaaagtgggcccacacttcctccactacccctgctgttgcttcctgctagagagctattcacagtccccgctgagcagtcagatccggccccattgtttccaccgtggccaaggaaccagggatgagaacagctcagctcccaacctccccaggccaccactcagtctgaggctgaagacagggcctagaaggggctgagggtctgctgagcaggccaaagagggcctccccaggcagaaggccatgtctgggcttgcctggggttagtggttcttatgcagggcctgttctgtcccacagtgggactcctcctcttttgagttgctgcttcctccaggcagtttccccaaattagcctccctgacttccaacccgatgccataatttctggtctatgccttttgcggtgataagagccaaatataactttaactttgcctgcagatgtccagggctggggggcagacaaacacaggttaaaaactgtgattcatccctgttgggtttccctcaaaccccaagaacaagcacaggctgatggccttgatggggtgatccagcaccgacctcacatgcactggtccctagccagcctgagccagctgccatctgctcgaggaagtagcttcagccattggaggagttggaggtttgtataccctcagggcagccagtcccacctggagggatatccaggaaagatcccgtaagagcccctcgggttgagttaaatcccctctagttatcccctcctcctgccagcactgctggcaacaccagcaccttggctgggaagctaagggaatcaagcaagccccacagaccatctgtgtgggggtggcccagcagtctcagcaggcacagcacagcttggtgccagcaagagacagaccagggaactgcaggtggtgacctactggggtgccttatctgcaaagacattgattcctaagagcaaaacacagcacactaaagtgagggaggccatagcacaaggggtgggggcacatggccctgcaggatggagccaccacagtcaccggctggaacggctcacagcagctgccaggagccaactgttgaattttcaggaattttgagaggcaggtgatactgcccacagtgggaatatttataccaggaaaagaggcaaatactgaaaatcagggttccctctccccaagaaagccctttgcgaaacatttacctacccagcacccacggggaagggggcacatctccctgtgcctacccacctgtgttaatcagggttccctagagggacagaactaataggagatatagacagatatagatatagatatagatatagatatagataatagatatagatatagatatagataatagatatagatatagatagatatataaaggggagtttatgaagtattaacttacacaatcacaaggtcccacaataggctgtctgcaagtttgaggagcaaggagagccaatccgagtctcaaaactgaagaacctggagtccgatgttagagggcaggaagtgtccagcatgggagaaagatgtaggctgggaagctaggccaatcttaccttttcatgtttttctgcctgctttatattcgctagcagctgattagaaagatggtacccaccagtattaaaggtgggtctgccttccccagcccactgactcaaatgtttatctccttttacaatgccctcacagacacttccagtaggtcaatactttgcagccttcaccccaatcaagttgacactcagtattaactgtcacaccacccttgcactaaaggtatacatacacccactagggcatggtcaaggtcagagatctgggccagacaggaactgaagtagatggttggccctaaccactgaaccacctgcctgcggcctcctcccatcagaagagagtagagcctgtttggccagagtggaatggtggcaggaagcagaggtactttccggagcgctggggtctgaatgggtccattgaggctgggccctgctgcttcctgtagggctgagtgggagaggctcacagaggctgccttgtgcagctggagcgcatagccagggaggcccccactccaacagaggcctctgaggccttgctggccggggctttggaaactctgacagcgctgcttccctcacctcctgatctcctttttctgcccctcttacactctctgaggggctgcagttgcaagaacccagaatctctgtcttggaggtagtggggggtgggcagttgaagaggggctttgaatggagagggtctgcacaataaagatgtaataagctaggagtcaatccagaggacttcctggaggaggtgatggtggtgtagagtcacagagagggaggaacaggcagtctcagaggacagcagcaaggccaagtgagagactggcagaggtatacaggtccccgttggctggggtgaggagggtttctgctccctcaccccccagagcctctggcttatcacaggataagagccagctaagctccaggggctttccaggaaaagtgtctcttggaaagggtgtgaccttttcatcggtcctgacagcaccctagaaatagcttggccttttccctcccctgagctccacagagaacacagccagcagaagacacattccctgtcatccagaaatgggtttgattctcagctgagggacagcaggactggtagagactgtcaggccacacagctacctacagagcacccccatgcttggtcgggggtgggagggatggcagggtctggctgtccacaggccgggcatgacagtggggcgcactggaagtggcgcactttggaggggcaatgtcaggggagagcttcctcttgttgggccacaagactccacaaggacagcacggtgactgattcccaatgctagaggcgaggcaatcggtcatgtgtaggtgtgtgtgtgtgtgtgtgtgtgtgtgtgtgtgtgtatacacacacatatgtgtgtatatatatatgagggtgtgtgtatgtgtgtgtatacataatttatttatttagatggagtcttgctctgccacccaggctggacctcagtggtgcgatctcgactcactgaaacctctgcctcctgggttcaagcaattctcctgcctcagcctgccgagtagctgggactacagtcacctgccaccacaccgggctaatttttgtatttttagtagagatgaggtttcaccatattggccaggctggtctcaaactcctgaccttgtgatctgcctgcctcggcctcccaaagtgctgggattacaggtgtgagccacagcacccagctatttatagatatttatagaatatgacctcaactatttaaacatatctgtaagggtataagtactttgataacaaagaagcaatacatactgatagaaactagctatcatgtcaacagtacttatattaggtagagaaattatgtgagatttttatttttttatattttactaatcttctcaataatggttgcttataagttttataatcaagaaaaaagatttctaaagtttttgcaaaatggaaagttatgcttctttatatactaaagacaaaaacaaaacttcctatttgaatacctttgacttttactgcagacttacagacccttgaaagaaaaggcaatcccctcccactagttttggtgtcattctccccatctctcccttcacttccaccttggtcttctttctacttcccaccttggctagtggtctccacccaaaatgcttgcttggcttaatggttagaattcagggaaaaagagatcccgaattgctaatctaaactaagattatacatgtgggaaataataaagagaaaccaggtagtaaataagatttggaggacttaaaatacccagactttaattcctctaagattatagttattaatcatgtttttatataatattatcacttaacatttaatttctaaatataatgttcatgaggaaaagagaaaatagcttggtttctttccttaccgaactgttgtccttagtatcttctagacgttccagaactgatgtcagatttggctcatcagagtccacagaccatatcggtgaagaagatgaataggattcctgtttaacccagagacacctatgttaaatgtttacatacagactaacccaaatatgcaattaaaccacaccactaaatggcaagatgaccatggatttaaacaaaatgtatcagggggaaaaggcaacacgtttaaacccatgtgaggagctggacttctgagacagccattctccttgcatagcactgtctgctgctacagctcatagaagtcaacaattttcttcaacactggtaggcagcctctaaatggccctgatcaccctcacctcctgccattcacacccttgtaaaattccacccctggacctagtgactcacttctaacaaagagaatacagcaaaagtaacatcgcttctgaggtgaggctacaaggagactacgatgcctgccttggtcacccttctcctgctctttccattgctccctctgatggaagccagttgccatgtgatgaggtgccctatggagaggcccacgtgacaaggtattgtaaaaggcctctgaccaatagccatctagaaacggaggcccagtccagcagcctctgagatgaatcctgccaacctgagcttggagacagattctctccctatcctgccttgggatgatcacagccaccaccaacaccttcactgcctggtgagaggccaagccagtgaacccaaggtaaactggacagaatcctgacccacagaaactgagataatgtttgttattttaagctgctcagtttgttacagagcaatagataactaactcaaacaccataaaattctaatattttattctatcacacaaaccaggtaataccaagtaaatgccattactatacatatatttttgtaacacaattacatgtgattttttaaaaaagctaatgaactatgcattatgtgctttcacccactaacagacgttcccgctgttactttgtactgttctctattataaattggggaaaaaccattattattatatattagtttcagaataactaggttcaagtcacagaaaacaattttgcacaaacaactttaggcaacactgctttgaaaactgtaatctgagttaaagctgaagccacagaaaccaaatatttactgaaggttcctttttaagaaaagcaagatgggccgggcacggtggctcgcgcctctaatctcagcactttgggaggccaaggtgggcggatcacgaggtcaggagatcgagaccgtcctggctaacacggagaaaccccatctctactaaaaaaatacaaaaaaattagctgggcgcgctggcgggtgcctgtagtcccagctactcaggaggctgaggcaggggaatcacttgaacccgggaggcagaggtttcagtgggctgagatgtccactgcactccaggctggcgatagagcaagactccatctcaaaaaacaaaaaaaaaaaaaaaaaagaaaaacaagttgtattgatggaggacatcattaacagtatatctcttcaataatggtttattttactattctcattcttctcattcctctcttactgtgttccaaatctctttacaggctaaaagaaactcttcagaattactcctattcttttttttcttttttgagaccgagtttcgctcttgttgcccaggctggagcgcagtggcacgatctcagctcatcacaacctccacctcccaggttcaagcaattctcctgcctcagccttcctgagtagctgggattacaggcatgcgccactacgctcggctaattttgtatttttagtagagacggggttcctccactttggtcaggttggtctcgaactcccaacctcagatgatctgctggccttggcctccaaaagtgctgggattacaggcgtgagccaccgtgcctagccggcattttattattattattattattttattttatttatttattttttgagacggatacttgctctgttgcccaggctggagtgcagtgccacaatcttggctcactgcaacctctgcctcctgggttcagacgattctcctgcctcagcctcccgagtagctaggactacaggcacccaccacacctggctaattttcatttttttagtagagatgggtgtcaccatgttggctagtctggtcttgaactcctgtgttcaagtgatccacccgcctcggcttcccaaaatgctgggattaagggcatgagccactgcacccggcctctttgttttttaatctgaacaatgtatttagctacttagagtcttagctacctcatcaataaaatggaaataagaatgtatcccttatttcatgtatgccaatgtgtgtgcagagtaagagagagacagagggcacagaagagaaaaaagatggttaactgggcatggtggtgcgagcctgtggtcccagctacttgggagggtgaggtaggaggattgcttaagcctaggaagcagaggttgcagtgagctaatatcatgccactgcactccagcctaggcaacagattgagagcctgtcccaaaacaaaacaaaacatgaaacaaagagaaaggggatggtatgtaataatatacatgtgattcacacagcaccagctgaataagccatgttaaatacagcaagtcttcacttaacatcgttgatgggtttttagaaacactgaatttaattaaatcaacctataatctcgaaaatattgcttacttcaatgtcattttattgtagtgttaatgagaaaaaattggttttgatagatatcaccttatttaaagttaatatttccaagaacctatcaacaatggccagtgagaactcactatatgtgtacatttccgttggcccttagaaaataatctcatagtattggtctaattacaatgcctttgtaaagaaaaaacgaacacatttttgttgcctgtgacaaagcttttagggctgcacacagagcgc

SEQ ID NO: 204 - DNA, 8945 bp, Artificial Sequence
  Description of Artificial Sequence: Synthetic polynucleotide
gctgcacacagagcgcgaactaactcaggaatgggaaaccagacattgtatgttctcacttataagtgggagctaagctatgaggatgcaaaggcataagaatgacagaatggactttgggactggaaggaaagggtgggagggcatgatggataaaagactacaaattgggttcagtgtacactgcttgggtgatgggtgcatcaaaatctcacaaatcaccactaaagaacttactcatgtaaccaaatacctcctgaatcccaataacttatggaaaaaaatagtcaacatcaaaaacttctcaaactctgtgtgcatgtggaatacgccagcccactaccaatgaaaagaacataatatctatccttttgagtatctagtccctatcctcatgaaaaaaatgcaacattttccattccagtaagaaaaattaaaagaacttgaattattgtggcagggacaactgattttactgtcttacttcagagtgatatgaataccctcattttctttcattatatagtctggagagacttttattttcttgatttttgacaaaaaaatgaaatgtgacatgtataacattatgctaactggagctggaaagcacgaattagcaagcagctagatgtcttaggaagacatacatatataagaggttgggaggtaaatactgttaaagttcaggagcctgccacataggtgaatctcctaagggtctagtggtctgaggacatgggatctatttttgaagggaagaaacaagtcacagatatttttgttagcactgcaaaataatctttaatgctaatttattctatgttctatttgtctcaaaaaatgtgctttgttctttcccatattttctgatatcaggataggaaatcaatagcaaacaaaacataattccattcattttttttccacagcttggttttcactgctgtttcctaacgcttattgttccatttactctttctctctgttttccatcacataaaagtaactttgtgttctttatctcttctaagaaaacttggtaatgagtctttaatgtgacgcctggaccacccttgttttgattttgtgttatgggtgttcttttgtgtgatcgttctcatggagagtccttgtgaagctgggcttttccagtggtttgtcaaaatggaaatagatatttaacaaaccaaacacaaaatgaccttgctccaggaatgcatcatttctgagaaaacactacctcttccaactagagattgtgaatattactcatattatcctttactcccttttattaaaactgtattttttttacacatttgtataactcgggtaatgaaatgtgaaactaagtgattgcctaccaattacaattgatattaatgatgctagtgggaggccacctctacagtggctgcaccatgtctagggacttgctagctttgctaagttacataggattgcctacgtactaaatgcaaacttactcatgcacataggaaaccatttgtattaatatgattaagaagccctgcctaaccctgatgaaaaattacttgaaaataacagaagagagtccttattttaaagtacattaactattgggagtaattactatcagtccaaacataactggatctaatgagactgaacagaaacaaattagacataattggaagctaagcaaaagtcaattaaactcctataattttacctttataaaaattattgaattaaatgacctggatcaattagcagaggaaataaagccatgaagaatatttccgggaaactattaccttttttgagggaaaaatattgtttcacttaatgattagaatttagtaaaatgtagcttaatgaattttgctgccttagcagtttaataacttcaaatgaagtaattatgcaaattttttgatagcttgacctaccaagtaatgcaggagttgttttagggaatccaggagtagaatttatttgatagaataaaataacatatttataaaaatcagcaaattcagatggtttggaataaagatatgattgcttttactcaatattcactttagggctgggttagctgtgtgggaattgcagttgacctgttgtagaaattgtgtgcttggaaatatatcaccacattgctccatgtagactccctctgtgattcaagtcttgttcctacagcactgctgtcaaccttcaaccaccgtcaccctatagaccccaagtcagtttgtattcagtaatgcaagtggtgttctgtgcaactggtcacccaagaacttggtgctaagaaactgagaaagtgatgaccaagacaatctcatcaaaacacagccagggccagtcacagtatcgtaatttctgctttctggatgttcaaggaaatgtagatcatgactccttctgtgatgcctcattatcttcaaaaggagctataagcgtacactcatttccaaatgtgatggaataagattgcagtttcaattaggtcctaaagtataattaattatataatagttataaaaatattaattctgtaaggacagtcacaaaggaaagaacagtagcaaataggtctcaggaaatatatcaaatgagatgttcaggtgtgatgcagctttgtacatactatgctaaatacattatgtctgtaattaaaccagctgcatacacaatgcaggtgtggcaaattctttgctgaaacatgtatgccagtttcctcattttttaaaatgacaagtgcatgcttaatcaggttagagtggatagattatgatattatcaatgcactggacaaatccattaatgatatagtgagtttttgtgcagaaatatggaatagagaggtgtgaatccaaactttgaagaataaagaacatacatttgtaattaagaaatatctctcactttcatcccttatgtgccacacatagcacaatccagccccacccagccatgactcttacatatatcactcctgacaaagccggcctggcaattcagacctggagcccagggaaaagagaggaatcccatgatttctggcaaacactgctgcttcttttgtagtggtgtgagatgaatgcctctacatgcacacaagtgccatgttgagggggatgaatctttcaagatttgtttaaagtcaaataatgtgaaggtccatgactgacctccaggcctctcagagcttcagttaactcctttgtgttaggggatgttagaagaacgtttacaagtcagagcaggtgatgctcaggagcaagagtgaatgaggaggaggaacccaaacaggtccagcacagaacatcagcatctgagcatcaagtctacccctgagaaaaagtggtccaaaggtttgtgtggaccccattctccaggccttacaaaccctgtgatttctgcctcattctgtcccgtcctgtcactttgagtctgaattggaagagagaaaaacagtaactagatcagtaaagtaaggaggagtgaagagcaggaaggtggaggtcgtgatggtggaagatggaaacctcctcgcgtgaaatagaacagtttggatgtcagctgtcactgctctagatctcctaaaacccactccatttttattaaaaatatacattgcatttttccagtgtacacgatatcatgttaagagttcataaagttttgaggatgtgagtaatcagaaaggaggtttaaagaaccgattattttggtggtctggctcctttaccccagtaggaaaagatgccattttgcttatgccctgtgctgaatttcagaatgcctgtcaacccaacacgcttcagcatgaactttaactcaaaaaatcaaaaagtaccaggatcaatttacaatcctagctatatgatattttagaaattacaaagcctgtaaatgagctattttgtcaacttcatagatgagaaatctaagagtgggttagtcagttctcttagatttctcatatccataaagtggatagaacatctaatttagaggcttgttgaaggatagacagaaatggcatttacaaagtatctagtgaaactactggtagggattatatgctcagtaaatgatgagcactataatcacaaataatttgatctttgaaagtgtaaaatgtatttgtctgtctgcttggtttttctcggaggcatagtttccctctgtcactcaggctggagtgcagtgctgtgctcactgcagcctctgcctctcaggttcaagtgattctcctgcctcagctgggattacaggagcccgccaccatggcccaactaatttttgagtttttactagagatggggtttcaccatgttacccaggatggccttgaaccttggcctcaagtgatccatccaccttggcctccgaaagtgctgggattacaggcatgagccactgtgcccggccacatttattttaattcagagaacaatttttcagtaaggttgtacaaatgattgtcctacattcctgcatgtttgaaactctttttctctttttgtctccatatgtgaatgacagtttggctaggtatagaatgcttggtttacactttttattgttcataaatctatagtcttatctttgttcccatcctctataccagcttgagtaggattagagtgtgggattcacctataaaactctatacccattgaacaagtcctcttttccccctccgctagtccctggcatctgccattttacgtctctgtttctaagagtttgactactttaaaaacctcatataagaaggatcatgcagcactgtgtttgtatttttgtgactggtttatttcacttagtatagtatccccaaggtttatctatgttatgacatatgaaaggatttcctttttttttaaggctgaataataatttattgtgtatataccactttttaaaatccattcatctcttgacagatatttaggttgcttttacctcttggctattatgaataatgctgcaatgaacatgagatgaacaagctccttttttatctctttacttttgttagaagcttttaattcctgattaatgagttctgaacgtatgcagaggtctctacctggcagtgacctaaagccttgtcttctgccaccccactcagccttcagattcacgtctctagattcttgaggttgggaaatgtttccctagcagccatggttttgcattcattggccattcaggttttctgctttgccatcttcccccgggggtttccttatcctcctggaagcacaactaggcatttaagtccatgttgactgtattttacctgctatttctatgtgttttgcaataagggcttttcaagatacccataacttgtggctaaaaatgaggtttgttccaatgtgccttagaaatatccagtttcatacttacctggcagggcagataccatgatcttaaaggcagttttcccagggcaaggcttatccattccactctggatccatcatagggatatgctgatccctggaattgccccaaatgtgggaagctctactgcaaaatttttggtagtgagcgatggcattatgcattcatgtatgaattcaactgagtatccagtttcatagaaataataataacatcttctataaaatgtattcttgtgtattaacacatggggctctctagtactcctgctgagatatatgggaatctaccctagttttgccattttctcctaacatcagtctacttcttttaatattcattgcttctccccatttctgtagttcagtgcatgttcctttcctctgcaggaactatttctctttcctcacccaactcataaatccctgcctcccaccctaagggtaggcacatgacccaacctgggagatcagaatgtcacacccccaatacaggattggtttgtgagtaggcagatgattctgtccatgcacagaactaagtagaagagagtttttatacctcagcttagcttgatgctagcagagagctactggagttctatttcctcctctagggaagaaaaggattttggtttggagataaagccaagataccaagaaagtgggaatgaaagacttagagacagggagtcctggccccttttcagatgctcagatgctggcactagcttgaggcccagttctgcttctgctcttcccaacagccccttttcagatgttggcactagctggaggcccagctctgcttctgctcttctcaacatttgttaaggggagctcccaatttcttttctaagatagctggtttgacttggatatccatctcttctaatcaagggtcctgattccttgtcattgtcatcaaaaaaaatttgtaaatatttcacttcttgctgacatgcttttggtgttgaacaaagtgatttgcacagatacaatctctgcatcttaatagcttacattctaagagctgtacacctggcactctttctctggaactataactgctacattcaagaatctttattaataatacttttcagatatatagttaaaaaataattttaatagttgaaaggcatccatctttccaagaggtttagacatactgcaattgagtgctaagtgacttttagtttgtatttttgtattttttaatatttgtatttccataggttattggggaacaagtggtactcaagatggatgaaggacttaaatccaagacaagaaactataaaaattctaaaagacaacattggaaaaactcttctagacattggcttaggcaaggatttcacgaacaagaacccataagcaaacgcaataagaacaaaaataaatagctgggacctaatcaaactaaagagcttttgcacagcaaaagaaacagtcagcagagtaaacagacaacacacagagtgggagaaaatattcacaatctatacatctgacacaggactgatatccagaatctacaatggactcaaacaaattagcaagaaacaaacaaataatcccatccaaaagtgggctaaggacatgaatagacttttaggtatttgtgtgtgcagacctcttggtgtcaaggctaaactgttcctttctctgacacataggaaattgatgcacaataccttgcagtgtataattccaggcccctaggctttggagactgggttatcttttcactcaactgacagttgatacattgtttgcactgaaaaatctggctttgttgaaccacaccagtttatgtttttaattccaaatgttaccttgttatgaactatttttttgtcctttcctctagagaaatgctaatgctgcttgcttacatggaaagtaaagttaaggagttggtgttgacattttggcttgctgtcacaggcaaaaaagagtagtgctgtttttgtgtgtttaattttctttcactttccccactctgtgtattggtggatgcctttagcaataagtagtccttatccaggtcactcactcattaaccaccaaccactgacagtaatgtctttactagatattttgcttcttttgattaatttgtctctatttcctttgttctaaagcctatagtgagtaatcatatttggagtaatagcagagctccctgctgtgttttcatttgcttaaatcaagacttagctgatgtattgaggaaccaagactgagatgtggggctaggagggcctagggtctgtcaggcactcttcagtgacttgaggtgctgaatgactcacactgtactgggagatgaccacctgtgtgcatccaacactgtcacagatgtgccattgagccaccaggagcagccacagaccatcagtggttgtgctttggaatacgcaattttgtgtttctggtaagctgtaatcttttcttttcccgtatgattatttttcattgaattatgctattaaaactcatctttgggtttcttgtaacgtcattgccgagaacattatttttgcatttcacagtgatttcttgaggaggaagtaagaagtaattgttttctggactcactgtctgaaaaacttgcactttactgaagcgattgttttatttacactaagtaacaatatgagttttgttagctttttggatggactacaaagcataaaaccaactttgttcctcatctctggcaaagatggagggttgttggcttgtgttgtgtgatgagtcttatacctggctctgtctgctcttgccttttgccttacatttcaaagacctcacttttttttttctttttttaaaaaatattttatcacgtgattttatatacattttaataaaatttcttttttgtaaaaaaagcaaagcataaataaaatagggtagccatttcttctaaggttatgttgaatctaacccaaactcttatcagagaaaactcttctttagatgtagcctaaagcaggaagcaacaaacctgtatacagccaaagtatcatctcaagggcctgcattcaaatctcacacatgtggcttgaaagtgatctctttcgcccttatttcaaggcctaatcttaggttacatactgcttaaagaagcttcagtatgcaatttcaaagcctgtagtagatgtaaaatgagaaaattagaaataaggagaaaagctgctacatgaggacactgacagcaaggaaagggagagaaaaactcacaaagtaagtggaaaaatagaccaatgcaaataaccccacatagtttaacagacctcatcatatctattgtgtacatgtttgtatgacatagattatatctattatatgtaacccagtgttcatagtgttgacttagaaattatcaaccaaattcaaagcttttaggctttgaaaattgtttgaaaagattttcacccaaaatatttaaattattaaaaaaaattattgttgattaaagttgtaatcctcaattaattagaagttttggctatccag

SEQ ID NO: 205 - DNA, 8367 bp, Artificial Sequence
  Description of Artificial Sequence: Synthetic polynucleotide
agcagcaataaacaaaacagcagcaataaacattactgtaagtataatccaaattagtttattgcaagacttattttaattcaggtaagcaacagctctctgctatcttgtgagacttattatattccctgaaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtactgtaagtaaaattacattctgtatgacagaaagcaaattataatattagaacaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtgagtcttatagttaaaaatgtaaaaattcattataaacaaagctaaaagacaataatatgcattgggaaatatttgcaacatttacttcaagggttgatgtccttaagagaatttttacaaattaataaacatttaaaaaggtgaggaatggcaatagctatgagagacaatttacaaaaacataaaaaatatgaaaactgtttaatctgtaagtacatcaataaaaattttattatagtagttatgttatctattaaattaggaaaggtcaatacaattggtaatcttccaagtaaatataggagagaaggtctttctcatacacttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctagctgcacacagagcgcccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctggggataatcagtaaaatggcaattggtgggcgaattaaaaatatattaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagttccttcctaacttcccctgcagccttgtcttgtggagcttgtattttacttcatgagaaatgccaaggagatgtcatttaagctgaaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactagggtgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaacatataaatgtgatcattggtagagataggaattaataggcatttgaatctctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacgtgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatatatatataattaggggaggaattgttaattctttcattttaaaaattttaactttgcagacaaagttgactatacctgtggcagaacactgcaacagctataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctacgtgattgtggatgttacctcttctgtgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctacaatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgcttctcaaatttatggtggcttatagctcttctaagtttctataaaacttcagcaacctgcagcaggttgaaatttattgatattgagttattcaccaggtcatattacaaagtcagggattgactcacccaaaccagatgctccccctgccaccagatcactaggagatattgcaatcatttcccctggttactaaattagcaaaaattctcagggagagagaagggcaagatggcacagtttaatacttactattattcttttattctttaccatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatataatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttacaccagtggtccccaacctctttggtaccagggattcgtttcgtggaagacaatatttccatggacagggttggggggaaggtttcgggataaaaccgctccactactcagatcatcaagcactagattctcataaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatctccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacggattatttaaaatagcagttttcccatgagtataaaaaaaaaagaacaataaaagcaatatttgttgagtattttaaagtgccaggcactgagcagtgtgctttgcttaagtaaatgtttgacaaaataaaaggtcttttaaaagttccatgctttaacattaataaccatataaagataaggttagactttctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttttgagacggagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacc

SEQ ID NO: 206 - DNA, 3128 bp, Artificial Sequence
  Description of Artificial Sequence: Synthetic polynucleotide
gcgctctgtgtgcagcataataccttgtttaacctcactgtggttatttaacccttgaatagttgagggttgttttaatggtacatgagagtcctgtgtcatttctggcctgtctaaaacacaggtgcctgtggccgccaccacagtgcctggttaaggcagggggaatgcctttctccctgctccttcaagcccctgtgactgttcgcttggggctgtaatgaagttttccttaatggacattgatacttggctaatttagtaggctctctgtctgctgaaacaggcaagttattttacccccacgtattttctctgcattaaaccgtgaaacttggctttgtcattttctaacatgttttaggaactcattgaaaaacacacatgtgaatgcgggctttctagacttgcatactgcagttcacagtagaaggccatcacccctgtgttcctagactgtgtaagctagctgagggcacttcccaaatctcccaggaccctcttgtctgcccaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcgtccggcttgcctggtacttcgttttcctggcctctgcttgtacgtgtgtgggttcccgcttcagggctgttgactcacagtggctggtgtgctgtgtgtgcctctcttaggtgtggaagccttggtcgggtggctgctggaccactccgacatacaggtcacggagctctcagatgcagacacggtgtccgacgagtattctgacgaggaggtggtggaggacatggatgatgccgcctactccatggtcagtgcctcccatgtgaccgcccgcacctgggccgctgtccgtctagcgctctaacagtcttacaccttggctttctctgtcccttgaaagaattaactatatctactgtggactgtttcataaaaccaacctatggtgttgccgggcacagaacaaagctgtgtttcactactgaagggatgattgggtttctatatcataattacttttagcttcagaacagacccttgttcaaacatctcatgatcttcggtagccattagaggatattttattaaaataccatgttttgacacatcagtttctgacctgagtaaattattcgtaggattaatttggaagtgccttggaaattttgtatacttgtagcttttgagattcatttctgcctactatgctactgctattagtcttttttaaatgaagatttttatagagaaaataaaggatttcatcctttactttttaatattatagatttcacagacatttctttttgagtagatttattgagttctcctatttttttttctttgaatgtatttatttcttgtagtctactggtgctgttgtgacggagagccagacgtacaaaaaccgagctggtttcttgggtaatgatgattatgctgtatatgtgagagagaatattcaggtgagtaattgtcttaagctggagcctcgatccgtttttcactcagcaaatatttgggtatgtcctatatgccaaacatcagtggacagaggcccctgccctcagggagcctgccttctggtgctggaagacatacctgaccagtgagctcatggtacgctagaaggtgctgtgtaccctggaatgagagagagcagactacagtaaaggggtgggagtgagggcacagtccagggatcgggatctgcaatgagaaggtgagatgggtgcaaagcctacagggtgtgaagggtggctgagcaggatgggcacccagacagaggctgctgtggctgccccggtgtagccagaggacagaggggcagatgggctcaggggcagccggagagcacaagtggcctgtccacggtggacatggcgcagggatggctgttttctactagccccacttgtgacacttcctacatacctttccttgtttttcttatgtaattctcattgccatcaaactttaaaaatctaattatgttttatatagtcctttatctactttaaatcatttcttgtcctaattctcttgttttagtatattttagagaaaatcccccaaatcatctcatttcacctgtatatatgtcagtgagtatcactaataaagaatcttaacataatgacatttctgtttaccagcattacctaacaaaataaataataattccttaatatcaaatgtccaagaaagggttcaaagttcaaattggctcataaattttataattctgtaggatttgtttgaattttcaaacaagattctaccattgaaatcccttttggctttcattgctgtgtcttccttaattttgttagtctataaattctctctatcttttccccccttgcaatttatttttgaagagactaggttgtttattggtagtctaggtatacctatagtctaggtatttgtcttagcctgtttctgttgctataacagaatatctgagactgggtaacttattaaaaacggaaatttatttctcacaattctggaggctgagaagtccaagatcaaggtactggtaggttagatgtctggttccatcatgacgccttctgtattctctggagaggaggaatgctatgtcctcacatggcagaaaagcagcaagaagagaacctgtgtccctcagaattcgtgtttcaaacacttaatacccaatgcagcattaattcacttcccaacacttatgcattgggtattttttaaaacatgaattctggggaacacagtcagactatagcagaatttcttattaaacttctgtggttttgtttaatatgttcctcttcttttgtatttccccagcataaacagttggatgaaatagttggatcagattcaggtttaatttttttttgtggggacgagattgtttctgctgcacacagagcgc

SEQ ID NO: 207 - DNA, 2959 bp, Artificial Sequence
  Description of Artificial Sequence: Synthetic polynucleotide
gctgcacacagagcgccagaagaattgtattttaaaatgtctaaataggttgctatttagtgcaattttttccagctcttaaagcaaagaaatgacaatttctaaacaaatgatagaagttaagtcaactaggttcaagcctaaacaaacatttttatcttagttcaatgctataagtgtatattcaatgtctgttatgtttaacacagtgggaggcagaagtgagaatgcccttcagtatacattgaaataaaaccattgcaaactgcctcagaaggaattgagtagttaattaataagcttttatttaaatgttgcaacccataaaaaagcaactcagcatgaacttgaaagttgaagataattccagcaaattccatgaccccagggctccagcaattacacaaaattaagagataagttcatgttaatgggaaaaaaatgaaaacaattatcaacaggaatctgagaaaataaactgtggcatattcagacaatataacattacacaatgaaaataaatcaactgcgactacatatgcaagaatataaatattatcaataatgttgaatgagcaaagcaagccaaaagactatatactacttttgttgagagatggtatcttgctatgttgcccaggctgaactcaaactcctgagctcaagtgatccgcctgactcagcctccccagtaactgagattacaggtgcatgccaccatgcccagctttatactaccatttttaaaatacaaaatcaagcaaaagcccttaatatgtaccttagatatatacggcaaactatataagtagtatatataaagtaaactgcctttttacttatacagtaaagattttttgaagaagcatggaaataggaaacaaaaaattcagcatagcagttggggaggaaaattagtatcatgttttcattcttaagctggatggtggctttatagatatacatttattatacttcatgacttacatattgaaatatgtagccattttaccattaaaattgcagtagttcacgtccgtaatccccacactctgggaggctgaggtgggtggatcatctaaggccaggaattcaagaccagcctggccaacatggagaaaccccatctctactaaaaataccaaaaatatatagcagggcatggtggtaacgctcctgtaatcccagctactaaggtggctgaggcacggcaattgcttgaacctgggagacggacattacattgagccgagattgcaccactgcactccagcctgggcgacagagcaagacctgcctccaaaaaataaaagataaagtaacagaagttactacggcagaaaacccattctctattcttgtatgaacttttctcagcctggggaaaggctttgctttggatgttgtattatgttccttgcttctttaggctgcttctaaagaggttgaaaacctgatactattttctcttctttaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatccaagatttatctcagcaagcacaactagcagctgcggagaaattcagagttcaaggtgaagctgtcggaaacattcaagaaaacacacagactccaactgtacaagaggagagtgaagaggaagaggtcgatgaaacaggtgtagaagttaaagacgtgaaattggtcatgtcacaagcaaatgtgtcgagagcaaaggcagtccgagctctgaagaacaacagtaatgatattgtaaatgcgattatggaattaacagtgtaaccatctgaaagcaactttttttggtgtctcaaaggagtaactgcagcttggtttgaaatttgtactgtttctatcataaataaagttatgacttcttgctggaaaaagaaaagaaaagaaatgctctctttttttggtctccaagtgccgtactctccggatctaccttcttccctggcttattcttcagtttcctttgtggtcatcttttcttctacccagttcttaaatattagtgcatctcaggggtctttccaaggccttgtgttcttttcactctgcacactcaacataggtgatcagattcatttctcttgctgatgatcctcaaatagtttcagtcccatctttgtcctaagacacagatttggatatccagccacctacttaccgtctttccttggatactctcccggcacctcaatcacaggatagccagaagtatactcatcatctctcctctaccggatgactagagctccttctccagtgtccccagctcagtgaaagtcaccatcatacccttcattcccaaaccagctactcgatactcatccttagctcttccctatcctttaaaatctctggcacccagtaaatcttcaagtcctattgctactgcctcctgagcatttctcagattcatgcacctctctgtgtctctactgccatcatcctctcccagattttcctaataacctactaaaccgtctctctacctccagtctctcttctgtccgatccattctgcaaccagagttgcatatcccttctttactgtatgagcaactgaaatagtctgaactcttcatgtggcttattaggccttgtatggtctggcctctgacagttttctgctattcccctaaatgctctggtcatactgaacgtctttcagttcctgcaacatcacactcccttgccctcaagcgtttacacatgctgttccctctacctggaacattcctagtcatctttcaaatctcggcttcaaaatcatttcctcaggaaagtttaccctaatccctagactagcttaggtctctctgaaatatgttctcattacgc

SEQ ID NO: 208 - DNA, 2732 bp, Artificial Sequence
  Description of Artificial Sequence: Synthetic polynucleotide
cttatcagttagctcccacttataagtgagaacgtgcaatatttggttttctgttcccgtgttagtttgctaaagataatggcctccagttccatccatgtccctgcagaggacatgatctcattctttttttgtggctgcataatattccatggtatggatgtaccacattttctttattcagtctatcattgatgggcatgtaggttgattacatgtcttttcttttgtgaatcatgctgcaataaacttacatgtgcatatgtctttatgatagaatgttaaatgcaattctaattctcatggtaggaatgtaaattgagcagtaaagaaacagtataaaaagcagattcttggcatcttatattattaaaataaggactttcttttttgaaatttgtcttttcctatatagttttccctgatttcttcatttgcagactgagagaaatgctgatgttttacctgatttcataaatgttagctaatattttcattgtttcagttcttattattgcaggtgtattttgtgcttgtatttttatgaattacttaaacataaatatttttcatgtcacatgataattctcagatacatgatatctaatggctatgtaatattctatcctatattatgccatttttatttctttcatctattcattcatttattcattgaatcatgctttctaatcgaggtattacagaaactgcttgaactcactttgaggaaagtaagtctatatgagatagaaagcaataacgcaagccaacacatgcataaaatgtatgattgaatatgttcattattttatttggcaattccaccaaaggatatactttttcttcctcacatgtttaaatatttcatagtgaaaatccttctgttttctcatatccttgagtcttaataaaataatatttaccatggtataatgttaaaccaacctacttttctttctcttttcacttactaatttatttcacaatcagagaaacggaaatagaaaagacaaagttttctcatttggtctcaaattttattaagaattatagagatgcaaaaagagctttgccttttattggcaaatgccagttcattgaccctttcacactgtaaagaaatatatcaaaaattgtcccttttgacgtgagctcatctctttaaggtcaccgagttctatggtcatctgaagcctcaattaaaaggacattggtaatagtaataacaagtcacttggcttcatctaaaatgtgccattgagcgtttcagtttgaaagagtataacgtgagtgttttgtgttatgtccttgttggcttctccccgtgcctgtcctacccctacagatagagctgcctgacaagtgctgctcatggtgattagccatgtaaatgagtacagtcaggaagctgctgtctccaaaatgtgcatatgtaattgctctcaacaatgcatatcaaaatcccatcagaaagcaaatcatttgccatctgaccttccattaattaattaaaaccccatatgggggcagagggaagtggaaacaaaggataatgtcacagtgggcacttcacagcagaactaggggatccctaccaagccttttttggaaaccttatgtctaaattctgggcatctggagaatggtactggataggaattaaaaaccttgagctctagctctagctttagccccaagaggctgagtaaccttgggcaacttacttcctcccattgagaactccttggcaaataaaggtctatgaattccattaggcttttccaactcagaaattccatgtttctcccactgggctatcaacaaattgaaatgaagagaatcttaacttttctcaaataacaagttatggtttggtttttgttatttttctttcctttccagaaacagggtcttgccctgttgctcaggctggaatacagtggtgtagtcatagttcactgcagcctcaaactcccaggctcaagcagttctcccaactcagccttccaagtagctgggactacaggtgtgtgccactgtgcctggctaattttttcatttttgttttgtagagatagggtgtcgctttgttgcccaagctggcctgaactcctggcctcaactgatcctcccacttgaacatctcaaaatcctgggattataggtgtgagccacagcatccagccaagaaaataatatattttttgattagtgtaaagtgccatgcaaatacagaggctcatgcctcttctagtaatattactattccaagacacacccatatagaaatgctggagtcactactgggtgtcaggacagaccatgtgcatatgcacgtagtgcgtacttgtacatgcacaaaaaaaagctctggtaaaatgcagattgaactagtgggtgacaaatggggaaggagtgtgaggtacagaattggggaggagtgaaaatgacggtgatgggggttgttatccccccttcatctgttctttcttctatagcagtggttctcaaccttaacctgcatgaaaatcaccagagagcattcaaaaaatgcagaagtctaggccctgccccccaaatattgtgattgaattggcctgtggagtgggaggtgtctatttgtttaagttttccaggtgattctgttgtgcagccaaacttgaaaaccactattttataacagagaagttttagctgggcacattgctatcctgctgcacacagagcgc

SEQ ID NO: 209 - DNA, 2723 bp, Artificial Sequence
  Description of Artificial Sequence: Synthetic polynucleotide
gctgcacacagagcgcccattcattcaacaggtatttattgacccccctgctctatgtcaggccttgagctatgtggaagactttgtgtttttggagccaagtactccagtggggggtagcaggtgggagagagactgacaataagtaagcaaacaaatagaacaacaagataattccagaggctgcagaatataaagtgggcaaagtgagagagaggggcagagaggaggagtggagtgcatctctatggaagtgtggccagggagggtctctgagaaggtgccatttcagcagagacctgattgaagagaaagtggcaacagccgtagggaagacctggaggaaaagtgttgtggacagagggatcagcaagtgcaaagcatcctggggggaaatgagctggatgtgtttccagaccccaaggacaggcaatgcagctggagccacagggtgtggccggaggacataagtaggggttggagtccgagaggtgggcagggacccaacccccagagccctggagcaaggagaatctagaatattgcaagagcaaagtgaagccagcggagggttcaggagggagtgacaggatgtgatctgcagccgaaatacattcttctggctgccacgtaagatgactgggtaaaaaaggggggggtttagggtggcagccaatcatttttaagcccgtttcagttccaaaatcctgtagtgcctcgcccctttcctgttctacaacaacactaaggataatctctaacatttgaagggtgttttcaacgtttacaaatcacattcgtgaacaattctgtttcattctcacagatgctcctttcaatactctcccagggaagtggactcctctgaccacctgcagggcagccccagagtggagcctccagggacctgggaccttcgagtgctctgctcgcagggccagtcggaaggctgagaatgccatttgtctggcggtgaacatccgttgtctgccagccagggtcccagaccccctctttgggtagtggtgctcccatcttcctttgaagaacctgcaccaccacctccatgcacagtctctgtggctcagatgaagccactgtagtcctggctccagggtggccaatcagagtttcccaacatcctggcttccacagaggttggttcaaattgagtcctccatttgtaccagtgagaaccaatcctgaggctgaagcctgggcttacatagaagatgctccctttcaggtgggatgggccacatggcagggtaggggccggaagggctgatggccagcaactggtaaaagcctgcctaagcagggagcccccacagaggagggctgacaaggagataaggaaggagagacttgttctgttggagcacccagatctggccatacctgaagccaaacttctctcaccctagggactcttcgatgacaagagcccctgaattcccctttgagtttgagctagtttgagatgcatttctgttccttgtgactaaagtgtcctgactcacagaaaccaaactatatcaagcatctgacatggcaggagctctttgtccttaaaaccccacacctgcaccttaagaaagaccattgcttctataggagatgtcatgagagaatgcagcaacttcaaactgtctgaatcgaagttacatgaggcccgcaggaagagttttacaactaaataagtgcaacatttgggtttccccaactgattctgttctctaagcttcttcattgctgcttctgctctgctatccttcatctagcattgacacttgtgtgctgagatggaggagcactggactgcgcgtcctgattctgcccttccgcagtcacatgatgtcagccaaaccatggacctctctgagagtttattttctcatctacaaaatagcgatagtacctatttcaatgagttgtctctggcaaatagtatgcactaagtacatgctagttgatgttaattgtactattattattagagagcagtgcatgttaagggatatggagtaagaagaggaagatactcctcctgctctgggaggccaaggaagatttcgggggggcggagtgggatgtgaagaacttgaaccttgaagattcacacatgatcagaaggaagtggcataaacaaagactgttctggggccagcaaagagtttatttgggttgatttgacagtttggagataaaggtctatggggcccagtttgtcaaggactatgctctctctgtaaggtttttgtcctttcaaagcaaattctgtgatatgagaggccaggcatccatttatcaaaagattcccttgcaaatattgtcactgtgatccacctgtcaagcaaaaagccagggcacataagaaggcgcacttttctcttttgtcagtaaggttgagtggctcaatatgcattcctcgaaaagtatattagaagaactttctatgtctgggagcatttacttttgattaattttaaaatagtaatctttatatactatagctctctttcgtgcaaactgaggagatggggagaatcttccttttctaatgtgaaagatatgcaaatgcagggccctaaaaaaacacaaagcatcaaatagctcagaaatataccgatgcagagggaaaacaaagactgtttccaaatagctcaatcaaaagaaagtttcaactctgtgaagtgaaagcacacatcacaaagaagttt

SEQ ID NO: 210 - DNA, 2682 bp, Artificial Sequence
  Description of Artificial Sequence: Synthetic polynucleotide
actgtcctctttctgttccaccacaaagcttcttgtggctttgtttttcgtgagaccgtctagtccctccccaactctgctttgaggtgttatttaaacaatgtaatcgggccaatctgcttctcataatgcctgactcattctctgtcttctacagtgtcaagtccaagtagcatgtctactgttgggtctgtgctgcctcccctcaatggctcacccacacccccacacacacacacacccacacacacacaccccacccatgctgacagatcaggccactgatgatttctggaaaatgtcagcttcctagggtggcatcgtccatacatataatgcaagtcacgtatgtaattttacattttctagcagctacattaaaaaagtaaaaagaggccaggcgcacctgtaatcctagcactttgggaggctgcggcaggaggatcaattgagcccaggagttggagatcagactgggtaatgcagtgagatcctgtccttattaaacaaacaaacaaaaaattaaaaataacaattcaaaaattctcatgctgatcagtaatgggattgtgcccgtgagtacccactgcacttggcaacatagcaagactctgtctcttaaaaataaataaattaaaaattaaaaaaacaaaatgttctttatggttacaactatatagtaagagtataaattctggagtctaggagaaactatagctttgccacttcctagatgtatgacattggacaagttactttacttctctgggcttcagcttcctcaactgaaaagtggggataaaaatcagtaccttcctcatatacttgttgtaatgaaatatgcatgtaaaatctaaaacagggtctcacaaactaagctcccaataaatatgagcttctatgtgtgatatatacacacatgcacacacattttaaggagaacagagaaaataactggaaggcaacactctcgaactctattggtggttatatgaagttggtataataccagttttttcctttccatatttccaagtgtaattaatataattttgataataaaataaggcaacagaaatcaataactgttcccacagtaaaaacacaatgtgcacagcattattagacattaggtaaagaagcagaaaggtctaactctgttgctcgggctagagtgcagtggcccaatcaaagctcactgcagcctcaacctcctgggctcaagcaatcctctcatgtcagcctcctgggtagctgggactacaggcacgcaaaacttaatttattttttgtagagacgggttctgtgttgccaaggctggtctcaaattcctggcctcaagcaatcttcctgcctcagcctcccaaagtgctgggattacaagtgtgacccactccacctgactagggaaggcttattaaaggaggggataagtggaaagaaggggcagagctgagaaggatagaacagaggcccagaagtggcaatgggcaggagagtggacaatggaaaggagagcaatgcagatgcaataaagggatcaattatgctgagctcagaagaggcaaatgactaaagaaagagtcttcaaagactaagtgggagaaaaacaaaaacaaacaaaacttagctttataaaataagctaccactataccataatgacctcacccgtgagtaaaattatatctccaagaaacactgtaaatgcccaaaatgctgcagtcctccacagaaaaaccttcttcttagtttctgattgatcaattactgtaactgttgctaaaggcactttagagccagaatttggtccgaattttatgtttatttccttcacatggcatggagatagcaccatgactaaacaattatacttctggcttttagaatcacagttttttattaatgatttttttaatactcttaaattcagacacatttctccgatccatttctacagcagaatctcctccattagaaatcaacttcattttcttagctacttgaaggactctagatagagcttcagactgggccactttatcttcagaggtacagcttcttttaatagcacttttgtggaaggtatttagttgggaacacagtattcctgagctacacaactcaatacgtatctcatttggtggcagttcatcttcagaactgaaaagttcttgagatcctgtatgttcttcaagacctttatcagagtttatgtgaatgcggctattttctgttttaggacaaacaggactaaaaagttcaagggaatatgcttggttttgtccactttcatatgcttctgtaaaaccatcaagctgaatcgaattctcttcaggtattcttatctccccgtaacttgcctttggttcagtctccatgtttacattccctttatttacaggactccgccttttatctttcttttgagctaaaaaagcaacctggctggaggtaattatacagagaaattccgtatcagttgacattttaaggtctgagaccttcttaactgctgcttcagaccttgacttatctactgagttcgaggaaaataatcccaaacgctggttttgtatttcatgatattctgttggcacacactctctttgtaccacttcaggccctatattaattttttcagtactacaaaccaaatccaacaagctgcacacagagcgc

SEQ ID NO: 211 - DNA, 2554 bp, Artificial Sequence
  Description of Artificial Sequence: Synthetic polynucleotide
gcgctctgtgtgcagctccagggaaatgcaaattaaaaccacagtgagataccaccttactcctgcaataatggccatgaggcaggcggatcacgaggtcaggagttcgagaccagcctggccaacatggcaaaaccctgtttctactaaaaatacaaaaatcagccaggcgtggtggcgggcacctgtaatcccagctacttcggaggctgaggctggagaattgcttgaatccaggaggcagaggttgcagtcactggagattacaccactgcactccaggctgggcgacaagagcgaaaactctgtctcaaaaaaaaaaaaaacaaaaacagcgactacaaaggagtaaattctcctttgtaaaagtgtttttttacaatttagaaaatctcaaattttctaaattgaacatgaattttagattggaaatcatgcactctgctcatctgtagagtctaagttctcttcggtgaacctctgaccaccctcctcccttcaaccccgtctcacggcacaccttgcttcccacccggggtcagccaccgtctatttattcagttcactatatcgactgaatttctcaatagcccgcaaccttaccttgccggataaatgtatattttatgatgccaaataaaaatctccattttaaaccacctctgcagatggaaaggccctgtctttatgctggtaaagaatgtcacagcacataccattataaacgccacacgtaacccattcatctcctgaaatttatgtcagaaagattggaaataaaatctatattaacagcaagtgcttaatatcaaatgcggtattaaaaataacaaaaattttcattcctgtaatactaagaggcgctcttcttaactccatttaacagacacacagtgccacctatcagccatcctctgtaactgcaggtgcaaggtaaagaaccgctcatagacatgccttcccctctccctgctatttacatgccaaagaccaccacaggttaagaggacagccctattagaagcccctgctctttctatattgtgttcttgaaaagttttacttccttaggaactggagctttttactgctgaactgaacccagggactgcaatcccagcgaagtctgaacaaatctgtgtctaaaatacgggctgttatgatacccaacggtgtcctaggagaaatccaagccaatctccaggtccagccctcaacggccgcctgatgggaagagacataacaattaatggcaaatttcttacaaggattacccacacgtcttctttcctctaaccaccccctcttcggcctgcaactgctgtgatttggcctctgcccagcttctctcacaaggctgctcacccctgtgtggtgaacccaagggctacctcttgaccctcatcctgtgtgacctctcagtgccacttaacagggccccctggcttctagagttttctttctcttctcaggcgcccacagatgagatgaccaggataagaacataggcagggctgggcgcggtggctcatgcctgtaatcccagcactttgggaggccaaggcgggcagatcacgaggtcaggagtttgagaccagcctgaccaacatggtgaaaccccgtctctactaaaaatacaaaaattagctgggcgtggtggcacacgcctgtaatcccagctactcaggaggctgaggcgggagaatcccttgaacccaggaggcggaggttgcggtaagccgaggtcgagccactgcactccagcctgggtgacagagctagactctgtctcaaaaccaaaaaacaaaacaaaacaaaacaaacaaacaaaaaacataaaaaaggcaggggaggggaagatgtccagtatgaaactgggggggatgttaatgaattctgttagaatggggaatctggcataggtaaaaacttaaacctatgctgtctaatacaattgttgcttgccacatggagttaagtttaaattattcaaatgaaatgtaacttaaaaattcagttctgtcacatgagacacatttcaagtgctcaatagccacatgcagctagtggctattatattggaccacacaggtgtagaatattctcatcattgcagaaaatgctttcagacagggctgacatagaagatgcatcagagaagaggagggggatagacgggtgggtagatgagaggggcacataaggtaattgcaacagaatgaatgtttatgtctcccccaaattcatatgttaaaatcctaacccttaatgtgatggcattagcaggtggggccttggggaagtgattagattgtgagggtagaggcctcatgagtgagattagtgcccttataaaagggaccccagacagctcccttgtcccttttgctatgtgaagacatgataagaaaacggtcctctaagaacgaggaagtgggtgctcaccaggctctgattctgcctggtgccttgatctgggaattaccagcctacagatctgtgagaaataaatgatttttgtttaagctacccagactagctgcacacagagcgc

SEQ ID NO: 212 - DNA, 2522 bp, Artificial Sequence
  Description of Artificial Sequence: Synthetic polynucleotide
acccggccttggacacgccattttcaactccgtggtgcgtttttttttttttttttttttttttgtaaaggagtttcgctcttgttgcccaggatggagtgcaagggatcttggctcaccacagcctccgcctcctgggttcaagtgattcttctgcctcagcctcccaagtagctgggattataagcacccaccaccacgcccagctaattttgtattttttagaagagatggagtttctccagttggccaggatggtctgtatatcctgacctcatgatctgcccgccgtggcctcccaaaatactgagattacaggcgtgagccaccacacctggccaagattgaaatcttaatgagagaaaagcagtttggaaacttacctgttttttattcaaagcccatcctctccttcctgttcatgaatggcaggcatcctgtggtgactaaagaaggtcctaccagctaagggatttcatcggcccaaggagcagcttccacaggagctccagcaggttccttggaaaaggtgacagtgctgggccatggtgccctgttcagaaatacaagactcagatttagtaaagccagtagtgtaatgtgaaatttgtttaaaaaatccttaaccaaaacatttcatttcataagaccgatgtattctatcaacagtcttttactgtatgttcatacttaacggcattaagaatcaccgtgatgggctggtgacatgcatctggttcatcaatgttagtggcaaagcttccagcatctacaactctagtcaccaaaatcaagaatgtctttctcttctctttttacctaattacaaaaaagggattgatttatgaaaagcaatatattaacaaatagcacaacttatgttcatatcattgccacttctagccacaaattaggagtcaggattaaggaaaacttacctaagttttcccaggctattttaaaattgctttttttctacaaaaataagtgttaaattcttcttttgaggtagtctcaattaagttgatgctaattggaaaagactattagatcttaagctgaactgacaattttataaaataaatagacttccttttctactattagaatgttctaataatgagttctattattatagtaatacttctgaattcccttttaaaatattgttactatcttggcatttttcagacttaacctgaaaatgttttaaatatcaaaatagacatatccgaagtttacaacaagggtgtacaatcatgatgggcacacttcctcaaacatgggggaccaacccaactcagacccatcacaccctcagcgtgtggaaatgttaaactatacaggaaccatggctggagacaaaaatctgtaggtgtccctgacataaaatgccatagtacttgcctgcagcctggacacaccctccaatatccttcaaattatctctagattactcacaatacctaatacaatggaaatgctacttaaatggttgttacactttattgcataaagaatgacaagaaaaaaagcttgtacatattcagtacagatgcaaccatccttttttttctggaatatttttgatctgaggttggtagaaagcaaggatgcaggacccacagataaagagggctgactgtatttaacacacacacacattttcttttgcctgagtaaaaaacaaaattgtacttgtaacacagctaaaggatgtcaacaaaactgttctttccaacctcaaattgatagagacgaccttcaaagtccacatagaacctcttattgccttttgtatttttagtagagacagggtttcaccatgttggccaggctggtctcaaactcctgaccttgtgatccgtctgcctcagcctcccaaagtgctgagattacaggcgtgagccaccgcacccggccatctctatttcttatacacaataatattataacaagaaagatataaatttgcttaatatgcagcttctgtttctgagttctgtagctgtcactcaataagataagaaagctactgatctcaccaaatcaaggacacaatactgttccctcaggtagcacaaattgcatgggctcaaaatatgggaaagacaatcaatattttatgaaatggtgtattttaaggctgacctacagataggaattttttttccaatccaagcaataaagctttgatgtggatgttcactccacatcctgtcctgatcctcagctgccagaggccagcctgcacttgccttcacactgcgtcttccttcatggcttcaggctaagattgccgggagcctcctataaatgtggtcatcttatggattaaacactttttttgttagttttgtttgtgttttagagacagggtctcactgtcgtccatcctggagtgcagtggcatgatcatagctttcggcaacctccaactcctaagctcaagtgatcctcccaactcagcctcctgtgtagctgggactacaggcacacggcacctgctgcacacagagcgc

SEQ ID NO: 213 - DNA, 2448 bp, Artificial Sequence
  Description of Artificial Sequence: Synthetic polynucleotide
gttctttttaatggagtaacatctgcttgatccaatctccagtgtcagcctctgatagggaatatgccacatctacagcaatgaagttttgcggaaacattttattttgtgacatgatcacacacacacacatacacacacacacactcaaatgctgagggtcaagtagggtaaacagttgtagttttctcggttatcccaatgagaatgatttctcctgccacaggcaggggtggttgggcgagttggcagcagagggagagaaatgaagctgttgggaacggtgcacagacagtaaccacggaagcgacgcacgtttctgatcctgttgcccgtggacaaagtgccaatggtggtgtcagaatcactggccttgccctttgtgtccctgtgtggcttttcctgccttatcttctcagctgtctttttacaacctatacagtctagatgtgtttctccaactgtgagctcttagagctttctgggccttttttgggccccccaccccggtggaaaacattcttttgtaagcattcatttttctgaagtgagtttaatacgtgccaaggtcagcatgacgagaggtgcgggttataagaaagcacagcattgctttccgacatgggcattcccatgggggccacgtcagttgtgtagaggaaggagacagaacaagcagcaacttgttgaaggcagcagcacagactcagaagcagatacgatccagagtccttgctcaaactgggcctgattaggcaaaaaactgtccttcagatgagcaaagatgctggaagctagctgtgctcttgggaggaaggagagagtggcagtgaagaaagagggcaggcaagtgatcaaatggcatcaccacatcatactacgatgaatagtcattcattattaatgactgtctgcagcagaatcttgaaactgcttcctagaaacttagagatcattgcaaaattgaggatcaaattctgaacatctgatagtagacttcaaaacaggcattaggcaaatatggcactttagctattattgattctggatagctaaatcttttttggttacaaagttaagtctggacctgggattgagacttggaattgcacataaataaaaagctctagtgtctgtggcttcagagtaggcaaaatcttggaatagactcactagtaaaaagcaaatgctttggaaagagcagctagagggaggatggtcacaaaggcaggagtcctaccttccaaaatatggcgcttaggtagacttccacacacttagattcacatttgagccttaaaaggtagagtttcagatcctcctcacatctcaccttggctgccttagtccagaacttccaattaccttgtcaccttatctaagacctcccagggcttcaggtggtcaccctcaggtggcacacctcctggcaactgcttttagttctatttagaggttttccggtggtgtccttaggagttttctcattgaaaacgtgtggaccccatggctacacttggtgttgcaggagagttctgtctcctgctttcatgtctcaggcttctgccatttctgccaaaacacttaccttagttgaagcaatatcagcagttccccggaggcaccttcgcctctgtctctttggccagcacctgatttcctctagttgaagagcttcacacgcataaccaggtgactattctgatgtttcattcacagtttcttttatgtcttttagagaagttctggttaattccaacaacccatgaaacgtcaagcattaccacattacaaccatttactaagctgtgtacaaggcagacactgagggctggcaaccctgggtctcggcaccctctgctgtcacttggctgggtggagactgccagcctgcacccctgtgtctgccaccactccaaatgggttgcacctagagggagggatcactgataccctgggtaggccctggcatggcggggacaggtccagcctcctcttggcatctcccgggagtgaaggccctttggctggaggagatggcctgagagccagtgtggtccacagggagaagacagaagtcctgagcagtgatgacgatgccccagacagccctgtgatcctggagatcccctccttgccaccctccactccaccctccactcctacctacaagaagtccctccgcctctcctccgatcagatcgtaagtgtgggttgtctgtgtggaggttggggaggggctgagctaattctgtcttagagtccctcaggacctggctgagaaatggctccagggagccacatgttcaccaaaggccagaatctatccccttgggagcctccctgatggcctccacttgaatacctccaagggcagggcgctcacttctcatgacagcccatttgtctgtcagacaccgggaaagctgtcagctgcacacagagcgc

SEQ ID NO: 214 - DNA, 2343 bp, Artificial Sequence
  Description of Artificial Sequence: Synthetic polynucleotide
gctgcacacagagcgcgcgctctgtgtgcagcacctgcttctccggaacgcagcgaagccagggcgctcggcctttgtgggcgtgctttgggctcccgagacccaagcccggaaggtctggcccctggtgggagatgtgtgcaaggagggccccaacccccctcagtcctcccagctcccctgcattcaaagatcctcctcccagtcagttcctttctgctgagatgctgaaatgcctttaagggtccttacagacgaggggctgccccatagagcatggagtgggtgggggatggggataacaccttcaatcttggaggcacaaaaggggaaataggggacgaaatggaaaaatacttttccttttatttttcccaggggtccgcatccttgatgaggaccagatggggaagatgttcaatagaatttggggtcaatatgtgactcagaatggcctgacagttgagaccccctctttattcataaaatatgaggcattgtcttctcaaggtggccatagcacttttttttctgatgatgtatacatttaaggagttgatataaagggtaccattaatttatcagggattgttgacaggaattgaaaccccagcgctagaataggtagtgaaaggagaggccgttcctttgttcatgttgtaatctggggtaagaaaattactaattttaaattcacaacagcttaccctaccaagtgtggggctgttttttatttttatttttaattatttaatccatctatgtttgcttccctaatgtggtgaatcatagtctcaattttccttctttctaaatgctagagtatctagcatatgatcaaataaagtacaatattatggtagtaactcaaatcatcccaagctgttgcctgtctctttccaccattcaactacaccatatctatcaaacctaaaaactcaactctaagcctcagctggaggtgagaccttgcttcctgtcacaaagaaaagggaagcatcacttattagaaaggtgcagaaggtgaaaagttttgatgcacataagacttttatagaagtgtaattttgcaattttttagcagttttaagtacaaaaaagttcttaactttgtatttttcaaataactattcataatttccatgcacagggttgagaaaactggctttccctcttagaaactgatagaaaacctccaaagtttatggtaaaagaactatcatttgttacagcagatgaagactatgtttttatactgcaatgtccatgtggcattgaaaagtatactgaatattgaataaagagccatgaaagtaataatattacttgaaacatttgcaaagagaattcaaattaggaagaagggaattaaaatgatagggaagtgaagttaaatgaatttgtaactcttgaatatttcagttataaacattcttacacaatgtatgaatccaacacctaaaggctcacattaaagaaaataaaaattgttttaggtctttaattccaaatctttctctaaacaaggaaaaaaatcctttgactcagcatttcttttggcttccaatttgggtactgcaggtgatttaagcattcatcatgttagcatttcaataatacatcttgtcattcctgattgagtatatatgttggaaatgccattttgaacagtaaaatcaaatatgttttcagtcatttctacactaaaaaggttctctaaccacatttatctgctagtaaatgaggactttttaaaatgcatctgttctgctgatgaatgggcttgcggagtgtttcaaacgagcaccagcattaagttgaagaaggcaaaccctgtatatcatgctttcatggctctcacattatactatttaatatgccgatagtactgttaaatatttagcaaagttcccttataaccctaccatctattcaaatgggattttaagacatttttgcagcacataagtaaaaatgatgctggagaactggaggcagttgtagcatggcttatttgcatccatctcactctggcacaactatacccatactgttagactgacattttataacttatttatttgtgctttaatttcggtatttacccagaagtcattcaggagcaggttgctcagtttccatgtagttgtgtggttttgggtgagtttcttaatcttgagttctaatttgattgtgctatggtctgagagactgttatgatttcagttcttatgcatttgctgaggagtgttttacttccaattatgtcatggatttgagagtaagtgccatgtggcactgagaagaatgtatattctgttgttttgggtggagagttctgta

SEQ ID NO: 215 - DNA, 2197 bp, Artificial Sequence
  Description of Artificial Sequence: Synthetic polynucleotide
aattagttgggtgtggtggcgcatgcctgtaatcccagctactcaggaggctgaggcaggagaatcgcttgaacctgggtggcggcggcgataacgcaattgcagtccagcctgggcaacaaaagtgaaactcaaaaaaaaaaaaaatcaccaggtctcagactcctgggagacagaccccagctccgacgttccagtgggatctcattaacccctgatactgaccttccaatttgatataccttccttttaaaatatatttattgaaatacaaagagtcaatataaagaaaaatagaggtcaccatacttggccacagttagaccgctcataggcccatggctgctgcaaccatgggcaggacacagagggagtccagcctctactgataaatctgggcaggttcaccttcgcaggccaagccaggggccatccctggtatgcgaaacctggaggttttccaggaagccggctgctccagagctagctgtcaagtctttagccccacaggctggtgcccagagccacttccacaggagcagcctcgggcttcacccacacccaaggagcttccgaggcaggaggcaagcaaggtgaagggagggttcagggtcccacaacagcagtgagcagggtccagccatcaggcctcagagcctctgtcatgccacctgcgagacgggctcctcctgtccccactgtgtccccgcttcctcctcttacagcagggggagttggagtcggagtcatggtggtggtgcctgggcctggggagaccaatggcagtcagtcactcggaaggagtcaaccaggcccccacccccaagaggcagatatggaccagggcatacctctcaggagatgtgggagaggaggtggcctcagctggccgcctgtgctctttgtctttcttcttcttctctttcttgtgtttcctctttttctttttcttcttctccttcttgcttttcctgtggctctcacaactacaaggaggatacaaggtgtgcctcagaccctagtcttgcaagccaagagagtgaacacaagcaggccccatccagatgaagccaccacccacaagtgcgtctttaaatcagttaaatcaaactacaaattccactcctcagttacgtagtcacgtggccagtggctaccacatcacgcagtgctggtgcaggacactgccaccatcgcacgcagttctcttgcacagctcaggtctacacactccgcctccatctcaccccctgccttgtttcccacctccctcccctccacaccgcccggtgctccagccacgtggacctggctgtccctcaacatgccgaacacacatctgctttaggcactctgcccggatgcccttccatacagcatggcctgctgccttcctttcttgagtcattgctcaaaggtcactttaccctgtcatggaagccttccttatctataccacataaccaagcaacccctttcccagagcatttgctatccccctgctattttattttctccatagcacttagcatcacacacacacatattgtttactcttttacctgattagaatttaagcttcgtgagcctagagacttattttccccccttaattatatcccaatttctaaaacagttcttggcaagtagagtgatctcaataaatattaatcaaataaataaatgaatacaggaatccttgaatctgtctgggggacactattctcaacaagacactgcaaattgaccaaggggttgacaaaataaataaaaatacacaaaggtttgagatggtcctgaacaattatcatctcttgattccaagataaaagtattttcaagagtttgagaactcatttaaatctaatttgaaaattgcattgattttacacccttccggaagggcatgtttcctgcagagaaagcaagtaggtgccatctagtggcaacaaaggagatccacatttgtgttaactggaatgtatcgattagcagtgattgaaaatgtagttcctgatccagaagcttatgaactctatgacagaacagttgtgatagccataagtcttgaagggtgcattttccatggaatatatggcattgaaaaaaacacagttccatttcttctaaattatttctaatttttccttttaatttttgcttgttttctgggatttgacggctgcacacagagcgc

SEQ ID NO: 216 - DNA, 2190 bp, Artificial Sequence
  Description of Artificial Sequence: Synthetic polynucleotide
tcactgtagacaaagtgagagacaaatgaaagattgtcttagttttaccttaaaagtttcacccctccctgttgagattgatggctgcatcctgttgccactggctctgcctgcggccagctgcccatgggcttcccagtgctctcccaggactgcccacctgcaggcccatggctcagtttcctctgtgcatgggcatcagttcagccagtgctgtccagagcaagctctggttacagctcctgcctccctatcactaaggaaaatcgcaggccccaaattgggtttgcccctaagcagctggcctgctcctgcagcccacatcaggcccctgtctgccgccagtgctccacgcaggcacccgccagtgctccacacaggcacccgccagtgctccacgcaggcacccgccagtgctccacgcaggcacccacaagagccacaggtttcacagggtggctttcattcttcaaccaagggggacaaaacacgctctggaggcctcctgtgattctgacagttcagagatgagagagacagagacatagacacagagagggagagacagagaggtagaggatgtcacagatacagagagacaaaaaggggagaagagggtattcgtgagcacaaacacagagagaaaaagcaaacaccttttggaggtgtagggagagaccagtctaactgtagttagggagttacagaaggagaatcaaagcaaacaagttagaaatgaaggttgtagtcagagtattgaaggctttggatgtcagtctgttgactagactttattctgaagcatttcaaaaactgcttccttgaactgccttttcagccacttatatgattctctttcttccaggagatgttgccaaatttgtgttttgcccttcacagttggggagaaaagaaggaagccaggacatttaatgtctattcctgtatataaatatataagctgtcctgaggaaaggtcttcccttagaacatttcatttgaaaatagcttatattaataactaacacattgtcaaatacagctaattggaggacacttaattttttctgcagaaataccaagtctcttaaaactctaatatttgaaaggcttaatgagatgcaagtgaaatagcatatggtcttttgctaacagtaaaggaaaaacaattactcaagcagacatgtagctcttagttaatgggaacaaagcaaggcaaaaatgtgtaaagctgttaaaaaatacaccaaatactgggcacatcaccggacagaggaatgcacccttctctcatggatactctgcatctcaacatccggttgatctcctggaagatacaggcttatggtaaaaaggacactttataacaccatgcactaaacatagctaaaagagtttatgttttctaaagtttttttttttttgagatagagtctcgctctgtcacccaggctggagtgcagtggcgtgatctcggctccctgcaacctccacctcataggttcaagcgattctcctgcctcagcctcccaagtagctgggattacaggtgcatgccaccacacccggctgatttttgtgtttgtagtagaagacagagttttgccatgttcgccaggctggtttcgaactcctgacctcaggtgatccacctgcctcggccccccacagtgctgggattacaggcatgagccaccgcacccagcataaagttttgtaatagtgagataatctctgccaggttcttggaggagaaaaattttattatttcattaatacttgtcaaaaatctagtgagcaagcaagggaataaatgacttccttgttgtcttgggagttttgccctctgcctctttctccaagtctcacagttgcagaagaggaccaactacctgaccattggtttggctctaggcatgtacaccataagtcaaataagtctgggaaatactgcatgaaataacacacctcacttcaactcagatttcctgtgcacattggcatattggaggttgagaagtcctgtagtaagctttattattattacattattatttccagttattttctcagactttccaaagcttgttggcctattgagcccattttatcagaataactcttaatatccaaaacccttatttttgtgagtcatagtttgagaattgcccatagctgcacacagagcgc

SEQ ID NO: 217 - DNA, 2172 bp, Artificial Sequence
  Description of Artificial Sequence: Synthetic polynucleotide
gctgcacacagagcgccagcaagcaagacatttcctctgttcctttttggggcctcaagaggattgggcctgggacacagacacacagattcactggcaggaacacagaaaggaacccacaaggatggcattgtggcccctgtccatactactaatccagacttagatttgtccacatctatatggacctctgcattccgtctactcacctgcaccttctctcatgagcagacacgcaccaagaaacacatatagaaatgtgaggttatcaaaataaaacaatgctactctaacctatattttctcatacaaaatttgcaatgcaacatgattttgtccatattaaatctactttaggaaggtttcttttaatacacaaaaacctcaccaaattacaaggctgtcttttaagttctaactggaaggccaaaatagcaaagatacattcttccagggttgccatattacgtaaataaaaattcttcatttttgatctgaaattcaaatataactgggcatcctatattttatctgacaaccctacactcttcaaactaaagtgagctcccacctctaccaaggtattacagcaccagctcccacttctaaagacaggctgtggcttctatcacagcaggattttaactaatgaagtcttaggagttaggatgaaagtgtccttttccaggtttttggaagttcatacccttaccagtaaaatcttgtacaaatcgaatttttaaattcctcatggtgcctcctccctcacttctccatctgtcatgatggggaaaagtacaaatccttccttctttgatctggaaaatttaatctatttcattctcctctgaaacttaattatgtgcttgtcttccttctcctatttgactggaaggcaagagtatatgtcttatccatctgtttacttcctctccagcacagcattttgcacagaggagatgctctgtgaatacttatggaatgaatgaatattgcattcgtgatgtatttaaaactagcagctattagccaacacagataactactcacgacatgttcaagtagttcttaagaataaagaaaaatttatttgaataattattattgtgaattttgtaaacattctaaatctcatcaatatgatctaaccttatttggaaataaaaattaggaaataaaaacttgggttttatttttatatatagatctaaaatttgaatatttttctgtgctgattaagtagaatttatcctggtcatttagattctgaacttttattttaatcaaaaatatttgcttgcctggattattgagataactgccataatcctccatttcttgtggtttatttcaattactgatcttactcagttttctgattgtatttgtcagacaacaaatcccctcacccaaaagactcattttagtgacagtaatcttattagtgaggaggggaactgcacgttactcgccggacagaatgctctcatgttagcctaagagcaaatccttgtacatgcgaaggtcaaaagactttccggtctgatttttctgaaaagcatgaagcaggatgttaaggcatcacacctaggactatgaaaccagaatgtgtctttagcaggtcaaatttgctcagtgtcactgaagtgacacaaattcgtggtttgggaaatattttgaagaagagacatatttattttgatttgtatcctttaggatactctttcttttctttttcaccagcaaaataaataaataaatacaaactcctcactctagagaaagaaaaggtattcaagcagagagaactctgcagatagatcatggctgtagaacaggatataatctttaattaaaaactgaaaacaatgaaaaaaatgtagagagtccttcaagagaagagagctatgatgatagtgaaagacaaactaaagggcatcacttacagtctaatagctaagctcttttcttttctttttttctttttctttcttttttttttctttttttttgagacaaagtcttgttgtcacccaggctggagtgtaatggcacaatctcagctcactgtcacctctgccttctgggttcaagcaactctcatgcctcagcctcccaagtagctgggattacaggcatgccccaccatttccagttatttttacatttttt

SEQ ID NO: 218 - DNA, 2146 bp, Artificial Sequence
  Description of Artificial Sequence: Synthetic polynucleotide
agcctctccaaaggagacaatcagatatacattgatctcagtgagcagaggggtgacttcgaatagaagggcaggcaggttggtcctaagcagttcccagcttgacttttcccttttagtcatttggggacatgaagactcattttcctttcagaatacaacaattccttatccatagttccccaaagtcttacctcttccttgcgttaactcaaaagaccaaagttcaaagtctcatctgagactcaagacaagttcctaccacctatgaacctgcatttttttttagttatttacttaagatacaatggtggtacagatattggataaacattcccatttcaaaagggagaaatcagcatataaaaagggagaataggccccacataagtccaaaacactgcatgacagacattaaaccttcaagctccaaaataatccttgactccatgtccaacatccagggcacattggtgcaaggggtgggctcccaaggccttgtgcacctctgtccctgtggctttgcagggtggctttgcagggtgcacctccgtccctgtggctgctctcacaggttagagttgagtggctgtggcttttctaggttcaaggtgcaaccagctggtggctctaccattcttaggtctggaggagggtggcagcatgattcccacaactccactagtcaatgccctggtggaaactctgtgtgggggctccgatcccctctttatcattggcactgccctcttagcgtctctttgtaggggctctgcacctgtggcaggcttttgcctgggcacttagactttcccgtacatctgaaatcaaggagtaggctgctaagcctccatcactcttgcattctgggaatatgcagacttgacaacatgtggaagcctccaaggtttatttataacttgtgccctctggagcaacctctctgtcctgcttattggcctcttctgctcttactctccctccactttctctgatccagtcacattggcttcctggatgttccttaaatacactggcaagcatctaccacaaggcctttgcacttacctagaacaattcttgtccacatgtccaattgtctctgcacaaaagtcacagatacctagtgaggccttccctaaccacccctgtttaaaacaacaactccacagttcactcccatcccctcattttctcaccctttctcatctttatttgtttccatagcacttttcaccacatgacctacttcatgcagtatttttcttttcttttctttttcgtttgtctgtttttgggacagggtctcactctgttgcccaggctggagtgcagtagtatgatcttggctcactgcaacctcgtctatcccgggctcaagtgatcctcccgccccagccctccaagtggctgggagtacaggcacaggccaccacacccggctaatttttgtattttttgtagagacagggtttcacaaggttgcccaggctggtctcaaactcctgagctcaagtgatctatccacctccacctcccaaagtgctgggattacaggtgtgagccactgtgccccgcctttatacagtatttttctaatttttaagtctattatctctctttctcactagctggtaaactccatgggagcaaggatatttgtttgttttgttccttgctatatatcagtgctataaagaaattacaaattcatgatgatcaatggccattaaaattatttagtgaatgggatattagtataataccaaagtagtattacatagatgactttctggttgcaaagggagaaacactactattaaatagaggaatctagtggttaatttagtatcattaatggcaggtcaaccaggtaatatgtcttttcttaagtgatgcaacatgaagttgacaatatcacatgaaatattatcttgccaaatatgcttaacttgaatccatagagcctttagatataactctcagtttacaaagtaaagaataagttaaaattcaccacaaggaagccaccagacaaaatcagaaggtggcacatcttgtaaaattgttcaaagtcatgataaatggtctgttctagatgagaagagacataagggataagggagctgggctgcacacagagcgc

SEQ ID NO: 219 - DNA, 2085 bp, Artificial Sequence
  Description of Artificial Sequence: Synthetic polynucleotide
gctgcacacagagcgccccctaattggcccagctccctattgtcgtctggggtgttgtgtttgagccggtgaaaaagttgaaccagaaacacattcctggtgaaaaagactggctcattgcagctgtggaccaccatctggggtggatctaacatcaaccaggggctctgagggggaaaagagccaagcaccaggtctctctaggattgttggatgtcaccacttttctgagagagtaggactcatttatcactaagatgtttcaaacacaagctgttctttcatagcgtatactggtaactggtcacctcattcttcagataaacagtgcatactacccttagtatcagaaacatgcttcccagttttaaaacttggattcctttctatttcttttggccccttcttaaaagtgaaaagaacaatgatgggagatctttttagcgtggggcccaacaagagatagatatgcatgtttgctgcatgccagatatcttttatttaattctacagctttttccagaatggctgccaggtagagcacctgcatcattttggcaaagtcctctttggagtggggtcttcaagcctgatcttggaattgcgttttattattgtctgcctaggactcaggtctgcactgtgggacacaatgctaagtggaaggccccttatccatggcaccatggaagcaggcgcaggatgcatgggaaactgcaatggcattaaaggaggaagctccaagtggatttggagccattctataactccttgaaaacaagactacctcggggatatttaggatgactcgtgtgtcaccaagtgagaaatacctagtgttggaacatttccagtccttctcttgatggttctactttctgcaggttgttttgagcctaccaatcactactgcatgaggactttgaaactcgagagggaattttttttttatcgataagaggtgcttatctataaagagccctcttgtgttttgattgacttatttatttatttatttatttatttatttatagattaaatatctgccgtgcttcttacatcaagagcactcacacaggagcttactgaacttttcctagttttgagtaattgtctgagatttatttaaaaacctatctaaattcaatatcagcttcagaaccataccacactgagaatcacattacgaattagagagagagatctgtgttcactcactaccttctacaatttttaagtagttacgtggcctttggtagtgtagttaatggatctgagaccagttttcctgaactctaaaatgaatacaatttcagtcatttgtgttgaactgaagttaaaattaaaataaataagtaatgaatgtcagttgttgacctctctgtgtgactatgcttttcttttagctgggcagatttacttataacacagagctatttagagattttatgtattttccattggttattaaattattatctcttttccgatttctaaggatcaacttaaattttaaataatcatcataatacaaatatttcttgtttgcttattgagatttacttagaagaatgtagagagtaaataatgtaactaaaataattgcataaaagagattgttaaaaatttagattagtagaaagtaaaggtcaatgttaaattatatgatttggctagaaaaataaatcacttcaacttgttccattcatttttttttttaaatactgcctttagaagtattatctttccattgagatttggcctgaagttcctagatatgtaaatggttccccaagtttacttagatgatgcatttaaagttgtttttactaaaatatatcttggaagtagactgtaggcttttttgatcaggtgacagtggtattattttattttgaaataaccatctggatttaagattattgtgggcctactaatgcagatatcatgttaaaaatttataactttataatagttaaaatttcctgaaatctgatggagaaagacaattatataagagaaagctactggcatatttccattgctaggggctaaaggcacagaacattgcgctctgtgtgcagc

SEQ ID NO: 220 - DNA, 2082 bp, Artificial Sequence
  Description of Artificial Sequence: Synthetic polynucleotide
gctgcacacagagcgcccattgctcttaggataagcagtaaaatacaaaacttggcctcttagtatttgtatggccagacccctgcctagctcaccatcttcaactcataccagtctatcagttgcccttgccctctgctttccacataatatatttggtcctcatagtaaccctatatgaaatgggcaatactggcatttaaccataaattaacaccgtacacagtgtcatactgagtgtggaatattgtactatgatggatttttgcatgtttctttggcatctcataatatctctaaattatcctattgtttgcagattaggcccggatataaaggactacttctaagtggctccaaattagttttcagtctcaacctagaaaaccagtcatttctgatccctagctttctgcatttcagttctcaggtcttttgcccacctccccacactttcttcgatacttgaagattgttcacacatctgcatttcctcttactgttcttccgacctgtactttctctaccactttctctgtccagaatacaaactaacatgtcaaggttcaatgcaagccccatttcctttgaaaggcttcccttgccttttctccaattcagacaaacttcactacttctcactttgagctccactctgttataggtcaatttcacctttctcacttcacttgatgttttgggacagtgcagtaggtggtaggactcttcactctgtctggatttgaaaacagactctcccacatacggtgtgtgattttaggcaggctagttcattcttctgtgcctcaatctgcttatctgaaagtgaagatcatgatactctcagagggttattgtgaggatcaatggagctaatttacataaagagtttggaacaatgcctgccacataatactttgtaggcgttagcactttcctttattttccttttcttatttttaattttattaaaggtttcccctgtctgttctgttgagacaggaagtagctgtttcttatctaccatttaatctttaggacctagtgtagtacttgatgggtataaattaggtgttctccggttgcttggaggatgaataaatgaagggtcaattaggaggctccagcccagctgcctttccttttgcaataatggagcaaacttatttgaaatgctagctgtgattacacattaaataatgtaggatcaaaaagccccattcatgactaccttttatcataaatgtttatcttttcattggtagagttatatattataagggcatttaaaaattgaaccaacccaaacctctatcagtgaactaatagtacatcaaaattaaaatcaatgatgaatgtagatctaaatttttcaacatgaaaatacatctctaatatattatagagtaaaaatatcaagctgcaaaactataaatgtgtagaatgatcacatttttgtaaaaaaaaggctgtgaatgtacaagtaatgcaaaataggatagtagacatttgtattcgtcttttttcacactgctataaagacatgtctgagactgggtaatttataaagaaaagaggtttaattggctcacagttctgtatgccatacaggaagcatagcagcttcggcttctagggaggtctcagcaagcttccagtcatggcaaagggaaagggggagtgaggtatctcatgtggtgggagcaggagaagaaaggcaaggtgggaggtgccgcacacttttaaacagccagatctcatggtaacttactatcatgagaacagcaccaaggggatgattctaaaccattattaagaaagtgcccctgtgatcccatcacctaccaccagacctcgcctcagacattgaggattacaacttgacaagacatttgagaaagtacacagatacaaacatatcattctgcccctggcccctcccaaatcgtatgtccttctcacattgcaaaatacaatcatgccttcctaacagtcacccaaagtcttaactcattccagcattaactcaaaagtctaaagtcttatttgagacgaggctagctccttccatctatgatccta

SEQ ID NO: 221 - DNA, 1986 bp, Artificial Sequence
  Description of Artificial Sequence: Synthetic polynucleotide
gctgcacacagagcgcccaggacatagggcatttggggatttgcaggtggaatcagagtccctgattatgtatccaatgaatcatttgaggagctttcattacctgtcagtaatgtaaacgcagctgtcatttgtgacaggttaccacatgccaggcagtctgctaagagctttgcatgcatggtctcatttaattatcaggagaatcctgtgtgatgggtattattatctcagtttacagacgtgaacagagagtttagctagatttgccaagagtacacccttagaaagtggcaaagccaggatttgaacccaagtcctactgactccgaagcccagcttctagccatctgtggaaatccagggtctgtgctgtcagtcttggctgagcatggagttaccctgccccgcaggagccactgtccagtgcagtgcacagtagaggaaccagggctctgacctggacatggcccagggacctttgtccaggctgttctgtgagctctaggccccagatggcaggcaggaagcctctgtgttccccagagcacactcctgctggccacagtggcctccaggtcactccagaagggaaagctgctgactaagaccctgtgctttctaaggaaagccacttttatttgagatgtcttgctgatcctcccagggcacccaggaagacaactgagatttttatctcatcttacagctgaaggaaaaagggtcactggcaggtggcttgcacaaagtcacagagctggggaggaacccaggcagggttcagaactaagagtctgaggctcctatccttttgctcgttacaactgggaagctgcaacccatatcattttattctcttctgttttattctgtgctctgtaaattggcagtgaggcttaaagtactgcaggaaggagaaatagaaatggaagagatttcaatcatactcatctttaaaatatacattttcaagatgttacaattacccattgtcaatgtatgaaaatggtatccagtgagcttcagattagggctacaaatattgattgatgggtgccacaatcagcctgacctggaaattctgacctggaaacaaagtaattgaactgaggagcccttctggtcaaacataaaatgtatcgaaactagacttattcttctttcatgttctcttacaaagattttttaagctaggctcaactgaaaattaaaaataataagtttatttatggaaaacttcttgcatccctaaaacttttaatggatgccaccatcaaaggtttcttgcctggaaatttcttaattcctcttattcaattgaaaggggctttgccagtagaatttgtaattctattgaattacataaaggagtacatgaagaagtttcttgacaggcttctaaacaaaatagcaatgtggctgtggacaattcttgcatgtgtatctcattttttgctggcgagcataattcttttacctggcttcacttggcggttgaaagaatacaatgaggtagaagataaaaaaatgttttccaaaatctaattttaagtcttatgcatagctgtagttcatctggggtcttcacttcttatttccctctccccaaaatcactattctccttttgccctgtgaatgatatctgaaataggattgtcaaaatgtgatctcagctaccatatttgaatgtgaaaccttatatttttaatagcaaaccttagcagaaaacatttattcaaaaaaaaatacataaataggcctggtgaagtggctcatgcctgtaatcttagtactttgggaggtcaaagcaggaagatagcttgagcccaggagttcaagatcagcctgggcaacctagggagaccccatctctaaaaaaatttttaaaataaataaataaataaataaaaacagccaggtgtggtggtgcatgcctgtagtcccagccactctggagtctgagataggaggattgcttgagctct

SEQ ID NO: 222 - DNA, 1886 bp, Artificial Sequence
  Description of Artificial Sequence: Synthetic polynucleotide
tttgcatgccagactagaaacagaaagtctgatttttagtttaatgtaaaactagagcatatttacaactcagattataattttgtagaaagaagtgccgaaaagaataaactagaaaattccatattaaataaaaaacaaattactgtttctaaaaatactgaaatacgggagcttctgtaaccatctaaatagcttacttccagcattatggattgagcactggcagagcatgagtaagaatatacaccatccagctgtaactcttcatggagtttttctctctcaccttttagagatttgaaaactaaaccctgactcactgggatgaagggcagaagggaaagggcagtgtgaagttactggtatagggactgctagtgatcacaactgtgcttgaagtagatccatttctacaatagtattagtgaatacacagaggctaaacagagaagagggaagattcacgtgtgttctgctttcccttactgtgttctataccttgtctacaatatcctataacctagagtgaaagcaaaggccaagaaaaattgtatggcactcctctaagagagcatgatcaaagatatactccttgaaaactataacatatttgaataatttttgaacatccttaaacaatactatgttttaaatatttaagctatttatttaacatgttactaaatgtcatctaatttaggaatgccagcccccagggaagagtcctctaagtgaggagagttgtgcagaaaagaaaggccattgttacaacagttttcttcccgcctcagataccgattctcagatgacagcatcggcaattagagacggacagattcctgccacctacctgatattggtcccttgttggccggctgtgtgtaggccacctccctagttcaggccctttttaaagtgtcacctggcttcttgcatcacctttgtagctggtccacttgccttagcatttcttcatgctgacatggccagctaatgtagaggagagcttcaactagtccacgcctgacatacaggcttcccacaaagcccagctgccaaaacctttcctggtactcaacttccagttgccccttctggagtcatggctacatctccttcgaggtacagatttttgagctaaattaccaaaaagagtcagtcagtgatgacctgagcaagtgtgttccaggcagtgcagaaggcccgtgcaaagaccctgagcccaaagaagttctgtcaagatcagacaacttgcagaggccagcgctgctgcagggtcataaagaaaggatcatagcggcttaatatgggccaggaatgagagtcaggaccagcccatgctgccaaaagaagagtgtggctctctagtcatggagggtgtcatgcctgaccatggcctagtttctgttggaagaccccattgagaccccaggagaatgaatgggggtgaggaggacaagagggaaagtgacagctcatctaacagtccaggggtgaaatgatggaggcttgcagaggaccagtgaccatgaaaccaaagagaaataaacagactcaagatatacaacagactgggtgcagtggctcatgcctataatcccagcactttgggaggctgaggtgggcagatcacctgaggtcaggagtttgagacgtgcctggccaacatagtgaaaccccatctctagtaaaaatacaaaaattagctgggcgtgtggcaggcgcctataatcctagctactcgggaggctgaggcagaagaatcgcttgaaccaaggaggcagaggtgcagtgagccaagatcatgtcattgcactccagcaggggcgacaagagcaagactccatttcaaaaaaaaaaaaagatagctgcacacagagcgc

SEQ ID NO: 223 - DNA, 1800 bp, Artificial Sequence
  Description of Artificial Sequence: Synthetic polynucleotide
gctgcacacagagcgcccgagcctcacaggaggctaaatcttatgacatagtgaggaactggtgacaagtggacagcctgtattcaaaaggctgggctgggccgggcacggtggctcacgcctgtaatcccagcgctttgggaggccgaggcaggcggatcacaaggtcaggagattgagaccatcctggctaacacgatgaaaccccgtctctactaaaaatacaaaaatttagccgggcgtggtggcggacgcctgtagtcccagttattcaggaggctgaggcaggcgaatggcgtgaacccgggaggcggagcttgcagtgagccgagattgcgccactgcactccagccactccagcttgggtgacggagtgagactccatctcaaaaaaaaaagaagaaaaagaaaaagaaataatgttaaagattttatttattttgacctcgaaacactgcttactattgagccaagtagtatactacttttcattcttatgtaagtattattacttgttctctttcccctggtccttttagcctcatttctttgttcatactgtttttgtttgaacaattgaaccattgtttcactttgccttttgtaacacaacagcagcatacattgaaaaatgcttactgtgcacaggaaatgtgctaggccctgaacgtataaggatgataaagacagagttcctgattttaaagagccattgaccttataggagaaaaacactggaaaaaatcatctccaccatagtatagtttagtctgtgcagaggagtcaaaagggagagacagtgactgaagtcagtctgagaatgctgtttcaaggcagactttccagtgaggtgcacctgatgagtaaggacaaatatgaacttaacaggtgaatggggagtggagatccaggtgaggcgacttctcgcatgagttaatgccaggatgtgtgaaactttactgtgtgttaagggaggcttgctggctcagcagcactggtgcttaaagtaaaaggggagggatgatgctggagtggggagcaggctcagatcccaaagggctccttatgaaatgttaaggaatcagcaaggagggttggggagccggggaaaatttttatctgaaataatattatagaccagcactggacctatgattctacagtaagagaaatgtcatttatctgccctgtccaatacattagccactagtcatatgtggctattagacactaaacatggctaccatggctgaggcactgaatttttattatttaaatgtcagtgttaataaccatatgtgggtagtagtgaccatattggacagtgaagctattgatggatcattccgatggctgtgtgaggatggtttatttagtaagatttattccataacatttttaaccctctgctatgcacttggcactagaatgtaggcacaaggcactaggaatatagctatgcctcagttggtcccagatcctgcctgcatggatctcttgcaatgcttgttaaaaattaaaatgcctggcccttctcagaatctggaggtgcaagctggaattctgtacttttaagtaaacccagatgattcttgtcatcactgcagtgtgagaaccactattctatgtttggccagttggagactggaggcaggatggccagttaggagactctgtgttgtggccagactgttcctaaactgtctaggagaaggagaaccataaagatccctagtgatcatgaatagctgttaggatctgaggccaccctcacagcaatggaagggatttagaaaatc

SEQ ID NO: 224 - DNA, 1793 bp, Artificial Sequence
  Description of Artificial Sequence: Synthetic polynucleotide
gctgcacacagagcgctataaagatttttaaatggtaggccggtatagggcatttaccatgaatgaagcttgcaggactggaagttgctctgggtgagtcagtgagtaagtggtgagtgaatgtgaaggccattatcatacactactgtagaagttataaacactgtacactaaacttatagaaaggattttctttcttcaataataaattaacctcaacttactggagaaactttgtcatatatggggtttgtttttgaccaagacctcattatgcagcgcatgaccgtaatgacttcagcattcattcagctttgactgttttcctccttaacttcattgctacctgttgcttcaattgtcttgacttttgctgcctcatgtatcaaatgatggccagaaaacgacgtctctaagctccctcaagaatctgtgcgtagctatgggaagaacccagagggctgtggccactgcttgtcttcggttgtcctgaggatctgcagaacctgagcaacatctgcaaagcagcaagatgacagcaaaggcatttggtttagggtcaaagatggggtggagggagcagagagggatttcttccttctgcttctggagaagggaaaatcaggcaccaaagtctcaatacttcacattctaaaaactgggctcatttaacagggccagatcaattcattttggaaacattccagaagacggggtttgcctggtaaatttataatgtaaagaagagggcaatgcaaacaactgctaagagtgcaggcagccattaattcattaataatgttgaacatctactcgtatatattgaacatatagaagatatcaaaaacacagataattgacctaaaagacttattacacccccaaattggagaatttatattcctttcaataatgtaagaataactttaaaaaatgacaatgtgccagaccactaaattgattcctggccaggcatggtggctcatgtctgtaatcttagcactttgggaggccaaggcaggaggatcctgtgaagccagaagtactcaaggggctaagataggaggatcacttgagcccaggggttcaactctgcagtgagctatagtcatgccacagcaccacttcaggatagatgacagagtgagactctttatctaaaataaaatttaaaaacaagaaagaaattctcaatacatttttaaaggattgttaccacttagagtacatgttctaattacaataaaatgagtttagatgtcaatgacagaaagataaccaaaaacttcatgtatttgtaaaacataaacatatctttaaaaatgggagtaaaagaagaactcatataggatatcagaaaatattagtgcacagaaagcataatagagaggaaatttttatctttaaatattatattaggaaaaagcctgaaaaataagtgagctaagaattgagcacaaaaaaagacactgaagaggggaataacatttccagtgacagccagatagctcatggatgaactacactgaggttaacttaaaaagatgaaaacatgcatttgcaatcatcattaagataatcaaacctttacctagctgtccaaagaagcaaaagcaatcctctctagatgatggtagtaatctctagagctttgaattgtctctagaatattcaaagacaaatattaagtctaaaatgctgatgcttacaaacagacaagagcagataaaaaagaaaataaattagaaaatagaaagccagaggagatggaaatttcatggttattatataca

SEQ ID NO: 225 - DNA, 1790 bp, Artificial Sequence
  Description of Artificial Sequence: Synthetic polynucleotide
gctgcacacagagcgctaagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataagcaaacatgtattcaatgctttgaagtttaagaagcatgatacaaatataaactatcatttttctgtccaatgtggtggtggacacctgtaatcccagctactcagaggctgagggagaaggatcccctgaggtcaggggttcgaatccaacctgggcaacataatgagacacttgtctcttaaaaaaataaaataaaatttttaaatgaaacgaagtaacatttttctgccctgttatcatctttataatatattaattccatgagggcaaagactctatcttattattcttttagtaccaggaccggtactgatagataaaggaaaaaactttatccaaaggatgaactactctaaaatagaccagtctctagcatctcatattccttctcagattaaagaattatgtgactattctttcttacagagaaacaggcatttgcaaaaagagtaatttccacctcagttcagcaaaagtacacaaacttaacactttctaggttcaaaaacttgggatggggctgttcagggtgccttccagatttagatgctagaaaggattctgccagttatcaaatgttcaatggcccctgtttgtcaaacccagtttggctggttctccattcaagaaaacaatggggtttgtaagaaagattctatagcacaaaatgaggagagcactcttctgatgaattagaaaaggcattattttcaataatttagcacaagaaagagaaaacaatcaaaatatctgcatgcattagtccattttcatactgctatgaagaaatacctgaattccacccatggtccctctc

SEQ ID NO: 226 - DNA, 1775 bp, Artificial Sequence
  Description of Artificial Sequence: Synthetic polynucleotide
gtagtgagccgagattgagccactgcactccagcctggtgacagagtgagagtccgtctcaaacaaacaaacaaacaaaaaacaaaacaaaacgaaaaaatcccccaaaacctactctctcttaaggagaaagaatagattgtacatagagcacagaacttggagcctatagacctggattcaagtcctcgctctgcctctaggaatgattttaaacaagcaattaagctctataaacctttattttctcatctgaaaattgagatagttatgacttcctaaactcactgtgaggattaaatgagataatgcacctgaagatatagcaatacgtgggcagtaaaagcaaataaacaggagcaaggattacatttgtattattatgatgtcaatcagagtccagcctatggcttgggtttgtgcttgtcaataagagaaagctccttgtgggtaagggtctcaatcaacaccctgcccatcccccatgggccttcagacaggagaatgggcatagcacacgtccctaaaatcaatcccgggggaactggtctgagccgtgcaggtaattctaacccgttcttcacacacgcttccccattgcttcggtaaaatgcacacaagagaggactttgtggttttgaagtgtctgaatacatttctagttttttttttttccccgccaattgtgtgtgtagatacagctcatgagaaaaggataacatttccaactccttgcctatcccaggggatttcccagagttggcatggaaggaagttatgccacctgctgctattagaggtggccctctggtcagcccagagagatttcttagaggaggctctgggatttgaggaggcagaggggcagtggagaggggatggctgtttctgttcagagctggtgccaccatgatggctggtattggtgctctctgatgcaaaatgggatattcctttgcaggtgattcctcctggaacaaaacacaagctaaacaggtatcagaggggctccagtacctatttgagaacatctcccagctcactgaaaaaggtaaactggatctggatagtaagggggttttgggacgagctggggtttttcatgtgatcggaaatgtttctgaggtctgcaaagccacatgtgactgggagggggaaaatggggttgaagtgcagagagcagtaccagtaaaccacctgcattaattacccaggtccttgggatggaaggctggtgctggagggctagaaacccaggaagaggggaaacagcctctgcagacagggactccctgtggagggagacccaaaccttgccctcaggaagtcctcagactgagggggagacatagcccctgctggggggagaagatgcagtcccctcagggaacactcagaaccgcagaggaagattcctgactgctcagcatttaaccttctgaatagtgaaaaatctactatcaaataatctggaagaggtcagtcaataaaaataattgaataattgatgatgttgtattaagctaaagtataacatatgatattcattaacccatcaagaaatattgcttgagttaaaccacatccctcaaatgagtatttctggtgctaattcaaaaggcaatagcagtcaaccaggggatgtttttaatgttttatgctttcactgcagtgctgtttatagaggggttagcagggcaataaggatcatatttaggaatgcagttcagtgacagctaaggcattgaactacaatcatgctgcacacagagcgc

SEQ ID NO: 227 - DNA, 1767 bp, Artificial Sequence
  Description of Artificial Sequence: Synthetic polynucleotide
tactctttgaatggcaatgcaagtcagaaggccaaagggaccttaataaatcataaagccgtaaattaatttcttctacagaactttaatcccaggtctttttaaaacttactggccattcagtctgtgactaggagcttctgttagtttttcaaacataatacatcatgctttctggaaagggctgtgtgcagtggctaacctgaccccccagattctggcatctcaaaatgcccacaggagtttctgaaccagaatgtgtggagcagaatttctccctaactagaggcaggctagttcccctaaaatccacatgttctctctgaaaatgtgcagtatctatgtgaatcagtacttctgcaaaagtcatgatttaatttaacaatgttgattttggttgcctttaccgtacacgacgaacatattctgaaccctaaaataaaattggaggccaattcttcttcatcttgttcccataacattccagactcagattcaagaaggagattgtgccaaaatgcaaaacttttgggaaacaagaaaacccaggaggcattattaagcaatcagcatctgaaggttctaggttttggcccaacagcttatttaaacatgctttggagccaggccgacctggatttgaattcaccattgccaccttttctgtcactggacaagttcctttgtgatccaagtgtcctcttctggaacatgaggtggataggcacccacctcacaggactgggtccacacaccagcacctggcagagtgggtgctcaatgtgagcacatttgctttctaaattttttaaaggccaggcgcagtggctcatgcctgtaatcctagcactttgggaggccgaggcgggtggatcaccaagtcaggagatcgataccatcctggccaacatggtaaaaccctgtgtctactaaaaatacaaaaattagctggcatggtggcgcgcgcctgtagttccagctacttggaggccgaggcaagagaatagcttgaacctgggaggttgcagtgaactgagatcatgccactgcactcccgcctgggcaacagggtgagactctgtctcaaaagaacagggattctgtctcaaaagaacaaaacaaaacgaaaacaacaacaagaacaattaaaaaaaacaacttagagaaaggccacttatgaaaacattaagtagacatcgttaaatttggagaaaggagaaggggtagaggtgagaaaagggaaaatgtaaagagaaaataaaggcttccttattttggtagaattccatgtggtcctttacaaactttaacgtgcatacaaatcacccagggacattgttaatttaacatgtgggttctgattggatagggtcgtggagtctggaattctccatttctaatccctctccaggcaatgctgatactgctggttcaaaattcgtttcactggtaacagaattccagcctcctttattccaggaattgcatggggtcaaaggcaagaagacccggtgcaatgggtggagaagcaggtggaggagtgggggccctgtgagggccagggaaggccatgtgagtgtgtggatgtgtggctgagggaaaggaggccagggatcaatgaagctttgctttttttttttttttttttgatggagtctcactctgtcacccaggctgggatgcagtggtgcaatctcggctctctgcaacctccgcctcctgggttcaagcaattctcctgcttcaggctagctgcacacagagcgc

SEQ ID NO: 228 - DNA, 1728 bp, Artificial Sequence
  Description of Artificial Sequence: Synthetic polynucleotide
gtacgtggttggagagagccctgaagacaggccttgccccacacaaacacagaacaaattgttctccaccccctcccaaaacaaaacaaaagcagtgaagagccacagagtgatgaccactacaacggatacaggattgctgagcccttccacgtgccaggggctgggcaaagaatttcatattcattaacttatttctcacctcaactctgtgagacatgcactcttcccccactgacagattcggaggaggggaggaacttgccaaagaacacacaactgcacatggtggagctggaatttgagaccaagtggaccactaagctacctgccaaactgagttgcagaaaccccaaaggaggcatagaacacggtttccaataaacaagagctcatgtgggcacttcctaatgacagaagctaactgtccaagagcacgactgtcttgggacaggagatcatgctgcagagcccagggaggtccgccctgcgcagagagggagtgcagacctaaagagagccacactctgtgaaaagtggaaaaacctacagattgatcccacctgttcagagcaacaggcacggcttcactcgggaccacatgtgcccaggggctccacagggctgggtcctggctctggccatctctgcacagcctctgctgggccactctgtgagaggtcacgctggcagcaagatctcagcctctgctcctttccctagtacagtttgatctctgaattcactttgatcttttaccagttcggcttcacctcttgcaccaaagctgtgatttctcagggcaagttgtcagctttcctgtatgcagtgtttttctaggtggattgtttctgatgtggtttcctctgatgcaggtgagggaagtatcatcttgactcctccaccaataaaattattctcacagggctttactaaacatgagacttgggagggaccaggcgtggaatgatatcgtttggctctgtgtccccacccaaatctcattttgaattgtaataatccccagatgtcaagggtaggaccaggtggaggtaattggatcatgtgggcggttccccctactgctgttctcatgatagtgagtgagttctcacaagatctgatggttttataagtgtctggcatttcctctgctggcactcattctttctcatgccaccctgtgaagaggtgccttccaccatgattctaagtttcctgaggcctcccagacatgtggaactgtgagtcaattaaacttctttctcatataaattacccagtcttgggcagttctttatagcagcatgagaatggactaatacatgttcctacacatactcttggccataaataaagttctatagtaacttttcttcaaataagtaggcttctagtgaacccaaaaatatgtgagcaaaacataaatttataaatttatgactcttctagttgtttattgatgactgaaatatattctctagaaaatctattttggaagccaataatcagaaatttgttgagaaaacacggacagaaaatgatgaaaggtaacgtagaatcatctttatcagcctcaacaatcactatgtcaagtgatgtgaagtcaaagatgtcactgtagaacttacttccattcctcttcagggcaatgattcattaagtcctctccaccattggcggctgggttctagaagcattctaaaaaaggagctgcacacagagcgc

SEQ ID NO: 229 - DNA, 1724 bp, Artificial Sequence
  Description of Artificial Sequence: Synthetic polynucleotide
gctgcacacagagcgccaaccaggaagcagaaaccataccattattttaactgggggatgcaattaaaatagacgttaggtattagagaaacaagaagacaacaaagcactaataaggaatcacatatgtaataacttcacaccttggctggggaagcaaaacagagtttgggattaatcaaatttaaaggcttggaagagaggtccatggggctagggttcagacctctgaggaggtgacaccatgtgcctggtgtttctgagagggcataaggagactgattgtggtaatgtagggtgcgaggaccctacaatctccccaaggaaagtgaaaaactgccactactggaattagctgtgtcttccagtgtgatgggccattgtggttcaagtttcttctccctctcccaatcttttgatttacctgtcgcacctccaaatggcagaacataaatgggaccagcagacaaaagagaagtgtgatttgcagagttcctgtcccagcttcaccaaacagaatgtggaccaggtgtcattacagtctcatggctgtaatgtcagcactttgggatgccaaggcaagtggattgcctgaggctaggagtttgagaccagcctgggcaacacagcagggccctgtctctacaacatatttaatatattagccaggtatggcggcaagggcctgtagtcctaactacttgggaggctgaggaggaagtattgcttgagcccaagagttcaaggttgccctcagctatgatcatgcctctgtactcctgcatttaggctggaacaacaacaacaaaaagcagaatcaccaagagtgacccaaagagtgaatgtagacagtgcttcaagtcctggaatactcccttgaggcatcaagcagaataggagcaaaggagacatagaaggaacaatcagtgaggttggaggaaagctaaaagaatccttgatagcccagtgaataaagcgctttaaagaagaactgtttatcagttgtatacaatgttaaaaaaaaaaactagtaaattgtgaatcaagaattaattaatgtatttcactatatatagtcattggtgacttgatcatttggtgaagtggtgggaacaaaaggccttttgggattttaagaaggaaatggagtagagaaattaaagacttcagtataaagagcattttggggattgcatacatagcattcaatatacatagcattttgctgtagtaggaagcagagaaattaggcaatatttagaagtcaagatgagatttccttttaaacaatgggagaatggaagcaggtttgtgtattgatgggaatgatgcagtagagagggaaatatggattgtgtaggaaactgactgaacaatttctgaaacaatgcccttgggatggcaagaagaggtggaatcaagtgcacacattaagagattttctttaggttggagcatggatagtgcatctctgatcatagaaaggatggtgagtttgtgaggacagatgctggaaagcatgcagatgtggtagaggaatttgttgacattctttcctggttccttaaaaccttgcttaaattttccatgtcatcgactgagagtgaggagagctgagaaaaatgtacgtaatagcgaagagagcaagtcagtcaatagataagcgcaggaaattagactctaactcttacagccgcagttttttcaccttcaaaatacagcta

SEQ ID NO: 230 - DNA, 1720 bp, Artificial Sequence
  Description of Artificial Sequence: Synthetic polynucleotide
atgataaagtgggtcatttggtgaatctattctcagttcatatctgctttgagatagcacagagtcacactcgaacatcctgttccaacctcgaagtttcctggttttcctttgtgaggctgcaacaaaagtatatccaaatacacattgatactgatgaaagcatcatcatcattagcctctaatagtcatcgagtacttgcagtaccaggtattttgatgagtgttttatgttctcaatcatgtatatgtttcacaagaattccaaaagggaggcactattgcaatgcccattttacagaggcgggcccagaactcacagaatgaggctcatacatctcatacctgaggcttggacccagagctagtctcggaaggttctggagccctttgggctgggacacagtccctgctgggatcagggacccgatgccaccctctggtgagagaagcagcccagtttctccctgcccatctctgaagatccttgcagtttattcaccagttcattcaattctcattttcccagagacagtacatgtcacagaagattcaagcatactcctgaacaggaaacttttctgggactcaagtttctttacctgtagaaggggcttaatgatagcatgtattattgttagtacttattattagtaatagaatataagaggtcattgtgaagagtcactgaggcatggtatataacatgttctgcacattgtctggtacataggaaacattcattatattcattaaatagtagcgatttttattctgggtctaggcatagagatgcagctgggtgagagacatagactcccttgctctggaagccttgtgtcccctggggaagccacaaccagagtgtcagcatgcaacatgcaggcccacccaaggagaagcctcgcagaggggcagctaagtcagccaatggggccacaaaggcgcaaaggcgtcctaaaagaagggaccactaagaccggatgcatgctcaggagcagtccaggcaaggaaggagggatggtgtcttgcccaaaggcacggcaggtgctaacgtgggtctgctggggcaagcggaggcagacggaggccagcttcaagaggcctgtgcaagcccctctggaaagctgggacttctgggggcactggggacatggcacagctgagctcagagaacaagagggtagatagagaaggaagaggggctgtagagagaggtgatggcagagggaagagaggggcatggagaggggccaggtgagtggggtgccctcaggcactggatcagaaagtctgggtgtgggctggggcggtggctcatgcctataatcccagcactttgtgaggccgaggtgggtggattgcttgaggtcaggagttcaagaccagcctgaccaacatagtgaaaccccgactccactaaaaatacaaaaaaattagccgggcatggtggtgggtgcctgtaatcccagctacttgggaggctgaggcaagagaatcgcttgaacctgagaggtggaggtttcagtgagccgagatcgtgccactgcactccagcctgggtgacagagggagactctgtcaaaaaaaaagaaaaaagaaaggctggggtgtttaccatccagcaaagggaggtaaagtgatagggagaggggtcctcttttccaactcaaatggagatgccatatgggctagctctggtgggctgcacacagagcgc

SEQ ID NO: 231 - DNA, 1676 bp, Artificial Sequence
  Description of Artificial Sequence: Synthetic polynucleotide
gctgcacacagagcgcagggttaaaggcatcttgcacattgaaattcaaaagcagattctttctacaaaccagttatttactgagatccttgagctattagtgtcaaagtgaaatagagtggtcagcagttatctagtaaattcttgataagtaaattaagccattcctaggcaataaaatatctgttcttgttaatggcagctttgcttctttttatcccagaacagtctgatgtttagtagccccagttattatacatgtgctcagacagaaattttcaaattgtcaattatttggtgaactactaacatgaatgtttaaaatattatgcttctttctacctctaatcatttatttattcaataaacatttagtaagttttagctgttttccaggctctacaccaagccctggggatagcgagaggagcaaaacttagctcctgcactcaagttcacagatattcataaatcattatagcaagtgacacataccataacagaattgtcctatggaaactcaaagagaagatgacagataagtacagaaggacgaagaggagtgtgctgggctgagtctggagaaaggacactcccgtcggaggaggtgcacctgcaaagacaggaagttgttaacacagaaagaacagaggaggtgatatcccgagccacgccatgagtatagaagaatgatgtgggaaaagaggctgggcaggccagtgaaggcatcctaggagcggtacagcatgccaaggagtttggacctccttctgcaaacagtggaaagccactgggagattttaagcaggacatactcagatttatgcttacagattcctctggaaacagttgggggcatgggctggaagggataagacttggggcaaagaaacaagtcaggaatttatacaattatccaggcaagaaatgatgatgatggcatattttttagccataaaaagaaacaaactactggtgcatgttacaacatttgaggatgaacctcaaaaatgctatgctaaatgaaagaatcaaatcacaaaagaccaaatattgtatgatgccttttgtgtgaaacgtctagaattagcaaatctatagagacagaaagttgattagtggttgcctggagctgagagtgggaacagaaagtgattgctaatgggcaggaggaatctcttaaggtgatgaaaatgttctaaaactggattgtgttgatgattgcacagctctgtaaatttactaaaaaaatcaccgaactgtgtatgtacatacattgagtgtgtttcatggtattgtaagcaaaatcttagtaattaaaaggctcttggtttagctctgggtaagatttgaagcagtattaagactccttctgcttttcggggtcctcttaggggcttacggtgagacatatcctgccattgaagatgacgtcctccctccaccatcacagttgccctctgcacgggagcgcaggaggaacaaatggaaaggactagacattgtatgtatgagacttttctcccccttttcaacttagaagaatgagaggtctgggttctgacctgtgctaaatctgtgtggcccaataaagagcacttgcttgaaattcagacatgggtctgaatctaggctctgccttgactggatgaccttgggtagctattgaattctgc

SEQ ID NO: 232 - DNA, 1653 bp, Artificial Sequence
  Description of Artificial Sequence: Synthetic polynucleotide
tgttgggataattgcttgagcccaggaagtcaaatctgcagggagctgagttcacgccactgcattccagcctgagcaatcgagcaaaaaccctacctaaaaaaaaaaaaaggaggctggtgattcaggaatgatagaaaaaaaaggatatgtactcaaaggtaaagacttaataaaaattaataatatttattgcttcataaaggatatttaaaaaacttttttttccctgtgagttgatggtggtgaagcacgcaagactactagtggactttagtgcctcattgtactaagacactaacagttttacccattatttcttttgcactattagtgcaaatgtcaacacagtgaaaaacccaaatatgatcttactgtaattgtgaaaatagttgtgacctcataggcccccagatggggccttgagatcccccaggaatccccatagcacactttgagggccactggtccaggccactgataccatttcctttatcagtgacttaggaatgacatgtgactgagttcagatgaaggagatataatgggatttttcaacctacttgaaaatgtttcctcaaacataaaaagggccccataggaagacagagcatgctgcttctgctcgtcagtgtcatgttttcgtgtgcatcttggctttgaaagggaggctgcctgaggatggctgagcagatgccattgagccacagggctgaccgcctcgagttaccttgagtcaggacttaaagttctgtgaaattaactttacttaagggaagaaggaagaaaggaagaaaggaaggaagaaaggaaggagggaaggagggaagggaggaaagggagggaaggcagctataaattattttataaatatattaacgattaaaaataatatacacaaaatttccactagcatcacttttttcttttccaatcattaataaatatattggctgtttactgtggaaagagcattgatttggacccatgggaccttggttccagtcctgattatgcctacaaatgatttagggaaaaacatttaatttgtctgactgtcagcttcataaactagattgtattgcatgatttccactgagcctgaaacttgcacattccttgacatttcctccaggagaacctttggaaagattttctttgactctcaattctaatgaaaacttcaaatgacaaatttgctgagtgagcatataagttttttattgctctgtaacaaagtaccccaaatgaagtagcttaaaccaacacaagtttattatctcacaagttctataggtcataaataggggcatgttatggctggattctttactcagggtttcaatgtactgaaagcaagacattggctggagctgtggttctcatcttggctcaggattctcttccaggtttacttgtttggggcggaatttcttttcttgcaactccaggactgaagtccccattatctttctagccgttggctgggatcagctctcagctcctagatgctgcctgcagttctttaccatgtagcaaccatagacaattcacaacatgagtgattgctttctcccaggcaacctgcagcatatttatgactgtcttctgctacctgcctgcagaaaatagtgcttgctgcacacagagcgc

SEQ ID NO: 233 - DNA, 1621 bp, Artificial Sequence
  Description of Artificial Sequence: Synthetic polynucleotide
gctgcacacagagcgccaagtcaccaaacctttctgcagattgtgatgactaatcgattcaatcaaacccaaagagatcagccaagagtctggcacacagaaattccttaacaaatattagttcttatgtatcctacaccttgtgtttatagcaagccagtctgcttgtggcagggttgcttagaaatcatttgacagtgtctaaacagtcactcccaaagttgttgaaaaattgacagtctgtagttgcattttgtaatgtttcttttagagcaatagggcagtggttttaactgaagcacgtttaaactgactttgttttgagaaattttagcaacttcataactgaaaaaaggcaagtgacttccaatgagtagcggagctgagatctggacctttcacctttctcttcaagtgggttgtgaggccagcaaattcaaaacccacagaatagagcatggagagtggggagtggggcatggttgccttgctgctgtgaccctccggatttaccgggacggttgagcaatgtgtagtgatgatgttaacaggcagttcaatccagtgatttacatttgcttgcaaatagttcttaccccaaatgacaaccaaaagaaatgttgttgagatgcatcctaacggggagtcgcttcctaggtccacactcctttctgtggctgcagtgcctttagggtgtctcaaagaaataccacgcaagggccgggcgcagtggctcatgcctataatcccagcactttgagaggctgaggcaggtggattgcttgagcccaggagttcaagaccagcctgagcaacatagcaagaccccgtctcaaaaaaaaaaaaaaaaaatagaagaaacaaaaatttagtatgccagaagcacatgctaagtgaatgataatagtataaaaaactagaaaaccaggttgcggtcagattatggagagacggagtgctagacaaaagagctaaataattggcggacaaaacaggccatgatcagaactttctgtaatgaatgtgaatttggcagaagaatcaaagggcaaagaaacagtaggtgatgaaattaaaggtaactcagtagtctaggatgacagtgagggtaaccagacagtgggaataaaaggactacaagagtataatagagaataggtttggcaactgaaaaaatatggatagtaattgagagacgagtcaagatcacaaggcattcccatgcctgtgtgacagtaagcaggttatacctttaaaacatataggaaccacaggaagaaaaataaattttatgaaataaatatgctttctgaattatgtcttttatgcattgttattaaattttgtttaatatttaacagtcacataaaaccacacaaaacacaaatttttctttttttctttatgtcttttttctttatgtttttctttttttctttctttttttatttctgtcaaataagaggatggaacgtattttacttaacagttgcttatttgatttattattgacatctctgacaatacatctcattgtcagatgtatgatttgtgtcacgcgcatccttgtgaagagaccaccaaacaggctttctgtgagcaacaaggctgtttatttcac

SEQ ID NO: 234 - DNA, 1608 bp, Artificial Sequence
  Description of Artificial Sequence: Synthetic polynucleotide
agtggggactctgtgtggggcctcccacagcacattacccttctgcactgtcctagcagaggttctccatgagtgccccgctcctgcagcaaacttctgcttgggcattcatgcattttcacacatcttctgaaatctaggtggaggcttccaaagctcaactcttgtgttctgcacactgcaagccaaacgcaacattaaagttgccaagggttggggcttgcaccctctgaagcaacaccctgagctgtaccttggcaccctttagccacagctggaagtggagcagctccatgtcctgaggctcagttcctgcctagagatggacaccgctgtccccccagggccaccagcaccaggaccctctgaagctgccaggtgcccgtgccccttggggcctcctcccaaggcccttgctcttctgcaccgaaggtcatgcctactgccccgggacactgctaactagctgtgggtcactggcaagtgtgttggtcattgtttgtgcctccgacagtgctctatgcagtcaccactcaacctggttgcacctctaagtcctgggctgcagccaaggtggctggatttcctgtgcctctgagctgctagctgctatggacacagccagatgctccaaggctcctgatccttgtcccgagggcatgtgaaccgacacagccaggaggaaaccggagcgctgactgctgcaggtgcatgtgcttgtgcttatgaaaagtggcccttttctgaggccgccaggtgctgctggcagcctgacccaggctgctgagggacacacttggatcaacatgctttatactgccaatggcgacctgggtcacctggcccggctagggtttgtcaggtttcttcactgagaagatgactcttctcctgtccatgctcccttccatacttacccttaggaaggaagtcattatgcacagatgcacagcccacgtttaagcagggctgcacacagagcgcataacttggtcccttttagtcacagctagagctggagcagctgggattcagggcaccaagtcccaaagttgcacagagccatgtgggcccagcccacagagctattttttcttcctcctaggcctccaagcctatgatgggaggggctgccatgaagatctttgacatgccctgaaggcgttttccttattgtcttggctattaacattcagctcctcagttacttatgccaatttctgcagccagcttaaattcttccccagaaaatgggttttccttttctaccacatggtcagcctgcaaatattccaaggctttatgctctgtttctcttttaaacataagttccaatttcataccatctctttgtgaatgcatataattgaatgctttcagaataagccaggtcacttcttgaatgctttgctgcttagaaatttcttctgccaggctgagcgcaatggctcacacccatgatcctagtagtttgggaggccaaggtgggtggattgcctgtgctcaggagttcgagaccagcatgggcaacatggtgaaaccccatctctactaaaaatacaaaaaattagccaggcatggtggcgcacacctgtagtcccaactgct

SEQ ID NO: 235 - DNA, 1603 bp, Artificial Sequence
  Description of Artificial Sequence: Synthetic polynucleotide
gctgcacacagagcgcttggccagcaaaagaccgtggaaaggttaaaaatcaaaggtgaatatttttaggtaaatttagggtctgttcctacagatactaaatattttagtctttgcatgtcatatagtctctgtctcatctactaactctgactttgcagttaatacccagcagtgggcaatatatcaataaatgggcatggctccgtttcaataaaactttattataaagacatggttggctgaatttggcttataggctatagtttaacaatccatggtataagacagaccagtttgtgataaaacaaaatggacaaaattgtgtctgtgtctgtgtgtgtgtgtgtgtgtgtgtgtgtgtgtgtctgtatgcaaaatcaatggaactgagaggattccaattcactttaaatattttcaaatacaataatgttgaagttacaataaagttatgttatgtttgatccaatacttgcatgagggtatgacttagtgcgtttaaacagcaacatcagtattattttccagctccccaagtgtctgctcaggctgccacaacaaaataccatagagtgtatggcttaacagaaacttatttctcacagctctggaggctggaagtatgagaccagggtaatcacatggtttctggtgacagctgtctgatttgcagatgaccaacttcttactgtgtgctcaaatggcatggcagagagggagggagagaaagagcatgctctctggtgtcttttcttgtaaggactatcagacaaaggctccttcctcatgacctcacctcatctaaacttaattatatcttgaaggcccctgtagtgtgaagggtcccaatcagcttactaaaaggtttatttctgctgcccaaaccctgaaggccaggccatgagccaaggccatgttgcccagccagagagcaggtgtccctgagaactcaaacattccagacagtatctgagaacctaccaagaaaaagtctcatcgcttaaacacagtaagcaaggagccagaaaattagctgaaaagtactttaaaaataataagcggtgcagatctctacagctgtcctgctgttgtcccggagtgcctcctatgtgaatcctaataatctcatctactcgccaagctggacttctccaagtcatttcttgatctcttggctcactcccagtttgggagaaggtatttctatatgattccaggattttctccttacagccccatcttcaaatactatcaccttggaagatagtgcttcaacatgtgatttggagggtacatgaacattcagttgatagcattctgcccctggggcccccaaattcatgcccttcatgcatgcaaaatccatgctttccaacctcccaaaacaacccttatttctttgaggacccaaacagcctttgtagaactaacaaattagccacaagattagaaattatggctcaggagtcatgtagccagaggtcacaaggctcataacctccctaactgcttctatagatagcatcactattgtaaaacttaagactggtgtgcaagacccttcattctgttggaccagctggttccacctggactggta

SEQ ID NO: 236 - DNA, 1564 bp, Artificial Sequence
  Description of Artificial Sequence: Synthetic polynucleotide
gcctcggcctcccaaagtgctgggattacaggcgtgagccaccgcgcccggcctgttgttttattatagaaacagaaatagagatcctttatttatgttgaaatctcctaatcaggaccccttgccacaataaacaatgaggtgcgtaagtaagaaagaaaaagtctatgtaaagagacaaatataattatctacattgcaagtttacttttaaaagagcctgaaatataaaatggcaaataataaaaataaatataacaaataataaaaatgcttttcagttttatgtctggttaagtgtgagaaatatatatatatatgaagtaaaaataggtgtgaagaaatgaaaacataagcaacgttagagatcccctaatgtaggggaggacctagaaaaaagacggaaggggtgatcaacctgcattaacagactttcagggaataatattctaattatattgttttaggatgttgctgagattttaaaatcacattgcaaatttataaccttgaacataaacaggtagctacatctaagtatttttccacccagattaactagttctgagagaactggaggctaggacttgctcacagaactgaagttccttattcctcttactagaaaaacaaacaaacaaacaaacaaaaaaagatggtccaatctttggcctggaagttggaattaagctcatgcaaacctgaaaatgttgctttctctcatcattaggtagcctaaggcaaagggagagaaagttcaccttatatgtgccttttccttaagtactatctcccctgcagcaggatgactttgcgttgaatatctaggtgcatcattgtgttgttaatttctccgttttctcctctgtggccactgtactttggtatagggctgtcagaaagaaaaacacacggcatgggcttagcatctggctgaagcctaaataagcagcactgccagacatcagaatatatcattactgtgatagttatgtttaaatgtgtggtggtgccattgaagttaagctcaaagttagctatgaaaatactgtgcagaaaaggttgaaatattgacatttctaaaaaaaaaaatctaaacatgtggatatatttttaaaattctagattattcttggcttgagtatataaacaaatactcctagcagtatattaaagaataatgtactatgttcataaatacgttattagaggaatgtaaaattagataaatgttaagaaatgtatcaatgaaatttttacactaaatagattaaagaagaaaagccatattctagaggctaagagggaatttgatacagccattctaaattttaaaatcttgataaaatagaaatggaatggaacttctttaacacagaaatgaatacacaaatagacaaagaccaataaagccagttccattaaagtcaagagtaatataacgatgtccaccacccttaatacttcatgaggactattctaaagggtctaatcaatgcaatatgacttttttttttttttagatggaggcttgctctgttgcctagagctgcacacagagcgc

SEQ ID NO: 237 - DNA, 1550 bp, Artificial Sequence
  Description of Artificial Sequence: Synthetic polynucleotide
gctgcacacagagcgccttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgtt

SEQ ID NO: 238 - DNA, 1521 bp, Artificial Sequence
  Description of Artificial Sequence: Synthetic polynucleotide
gctgcacacagagcgccttaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttatcattttaataagagcagacaaaggattgaataaaatttagtattgattcatgcaaaaaaaaatcctaacaaatgagaacaaaagttccagcctaacttttacctggattaacctccctgttctgtcccatagccgtctcttaatgatgagtcaatgaatgttcactggacttagttacgagccactcttgcttgtcatttaaatgtttaaaaaataactgaataagtgaaaactcaagagtcgtataaaatggaagaggtagttctgtacacagaaggttggaagctcagttcctagggtcagaattagtaaacacatgtgactgcaaaaagtcaacctaatagactagagcaaagaagcatcaaccaggcagaatgacttacaataccatttataagccaatgactcccaaatttctagttccatcctagacatctcccaaactcgtctcaaatattcaactgtttattcgtcattttcctcttatgtatccaaaggacacctcaaagttaactgtcccaaactaatttatttattcccccctcgcccccaaaactgccccatctgcagcctttttcctctcagttgacagaaactccattctttccattctaactcttttctctcatactccatcaggaaatcctgtgggttctacctttaaattacagatagtccctgacttggatttacaatttttgagtttgtgatggtgtgaaagtgatgtgcactcagtaggacatcaataagttacatgaaatattcaacactttattataaaataggctttgtgttagatgattttacccaactgtcggataagttgtctgagcatgtttaagataggctaggctaagctatggtgtttggtaggtgtattatatgcattttcaacttatgatactttcaacatacgatgggtttatcaggacataaccctattttaagtcaaggagcacatgtatttccagaatccagccacttgtcaccacctccaatgctctaccttggaataagacactactttctcctggattactgcaatagtcccctaaaagatatcccttaattctctacagtttataattctatgtagcttatttatagcagccagaatgatctttttaaagcataagtcagatcatgtcattcttccacccaaaactttgtaatgacttcctcctttactcaaggtaaaagaaaaaggccatcagatggtctacaaggccatacatactctgaccccattagctcctctctaatttacactgctccacccacagtggcctccttgtttcttgaaaacaccag

SEQ ID NO: 239 - DNA, 1504 bp, Artificial Sequence
  Description of Artificial Sequence: Synthetic polynucleotide
gctgcacacagagcgcccctgccatccagcccacccagagtctctggatgggctggctggtgaaggactttcgttgccaaaactagtctgtaaagattggaagaggtgcctactccttctaacacagagataacaatacaaggccataaggatcacaaataatcaaggaaacatgcccccaccaaaactaacaaacaaacaaaaaataaataaataaagcactggtaaccaaacctgaagaaatggagattacctaacaaagaattaaatatgatcaacctgaagctcagtgagctatagagaacgcagatatgcacctatatgaagtcagagaaactatatataaataaaatgagaagtttaacaaagagatagaaaccataaaaaagaaccaaacggaaattctggagttgaagaacacaatcactgacctgaaaatttccacagagaacttcaacagcctaataatatatttggcagggtgaattaatgaatgaatgcatgaatatcctaagtttacatatattctttatcagcaataagcatttgaatacattcctctggcccactatagcagctgctataatcatactgaaaacatttacttctagtactctcagaatataatacaataaattgttttaaagctacaatgcattaatcaaccagatttcaaaatttcacactgctactatcctctaataatttcagaatcattggaaacaatcttattgtctccccttttcttcctgggctcacaaatagtgataccaagaatgattttgcattttatggttttagagagatctattacatactgcctaaacctaaatatccacttctaccttgtcttaaaacaagcatgaaaaactttagccttatgaataataaaatttattgttataatatatagacttatctttgtctttaaagagtcgcagcaaggaacaaagttaaaatgcaacagaaattagtggtagcacaaaattttagtagctaaactttatgttaatttctttcattttaggctttgcttcctttctgacaattttgctaatttagcaaagatttttctcaacataggaaaaaactaaagtgtgttcctattctctcactcaacaatcaacacagaacacttctgtgaccaaacgtataggggtgtaccccacattccaacctccagttcagcaaattctgacatgatctacctgcaggtagtgtctgaccccacagattcagggctcattccacatggcagcccctcctttcttttttttttgagacagactgcagtggcgcgatcttggctcaccgccacctccgcctcccgggttcaagcgattctcctgcctcagcctcccgagcagctgggactataggcgcatgccaccatgcctggctaatttttatatttttagtagagacggggtttcatcatatggtcaggctggtcttgaactgctgaccttgtgatccacccacctcggcctcccaaagtgctggg

SEQ ID NO: 240 - DNA, 1474 bp, Artificial Sequence
  Description of Artificial Sequence: Synthetic polynucleotide
gctgcacacagagcgccctcgcctcagaaacaaacaaaaaaagtgttggtataaatgtataaatgcagtgagagacgcatgtgacaacagcagcccatgaagggtgtgcaaagggaacatggggtttccttccgggtgtgtgcacagaggggtgtgtggaggaaggaaaaccacacaggggattgacgaaggattcaatacatgaggggctgctgtgaagtatctgtagggaaaaggagatggagatgaccaaaaaaagtggaaggaggactgcgtcagaaaaaaacagaatggggaaataaaaaacattaattgggaaaaagaggcagagaagtatatacggtattgccaccacataccatggactctcaggactggttggatttcaaataattttctttcccagtaaacaaaacttgttaaatattatgaatactaaatgtatacctaacagttctgatttataaatttattcttttgaaaacaggtcgtttttggactatgtccttgtatacaaggagcacagggggagcaaaagagcgagacacgggtgtgccgaaggatgggggtcaggaggaactgcaaagcagggaactttgaagtgggacctggttttagtccgaaccacctcggctgatgaccttgggcaatcgcataacctctctgagccacggattccccacactcaaaacgggcagggaggccgtgggactggcccgggggatgcaggcagagcgcccagccccagctcggcacagcgtgggtggcagggcgcctggagaacccacagaggcggcggggagtgaggggcgcagaccgcaggtactaggcgcccaaaggctgaccggcgggaatggcgcaccttctgggagccagaagacgccgagatctgggcccacaccgctctgccgcccatgctttccgcaaccagaagtccaaaaccctcggggccggccgcccgggcgcggcctggaggccttcagcggccgggtccccggatccctggcccgggtacctggcggcgtgcagcgcccgcagcgcctcgcgggcgaactggtccgtgccgaagaagagcacccgccagggaggcttctcgcggactctggagtcccggcagtcctcccagccgagtcgggccagtgctcgccactggggactcggcctcccacgcctggcgccatgagccagcggaggaccccaacagcgccgcaccaacaccctcatcgcctcggccgccggcggccggccctgcgcaggcgcatcggggcggggacaagggtgcagcctggggagggcggggcttgcctgcttggaggcggggtctggttggagttggtgaacgaatttgcccgctacagcggccctagatttttgttctgtttatttgcactatgtagccaatcctccagaataagtctttcttttctttttaaaatcgatttatttatttatttatttatttatttatttattt

SEQ ID NO: 241 - DNA, 1471 bp, Artificial Sequence
  Description of Artificial Sequence: Synthetic polynucleotide
gctgcacacagagcgcagatgattactttttgttattttggtcagcaaattagtaaagtcagagggtgaagttgggaaaatgccagttagcttgtggaaacttgcaggcttatttctaaaacttttcaggactgatgttaattacacaggcatctgaaaagcaaaaatgggttttaaatgaacactatcttagctgtctcatgaagaaaagagagggaatgtttaaactgttcccatctgtgtgtaacaaagcttttctctcaggggaaaaacacagaatagaggtgcaaatgctgagctacctcattttagactttctaaagttatataacaacatgacaaatatgtgctactggaaaatattgtaggaaaggattagttttctcttccacactgtcttgatagaagaagtaggtaaggaaaatctaattttttaacgtttttttccagcagtgtatgttaagatatgaatctgtagaaatacattctttagataattaaattgagatacggaatttcaggcaataggctcttcattcaaagaaaaagagtaaatcaaatccaaagcaagcagaaacaatctaaaaactaaacctccttgtcatcttccctggtctcctagaagcagtatattcagggctctgtagccagccaggaagagaagtgaagaatcttgaccccaggatcccagtggtcagggcaaggagtccagtatcgctgggcagtctgccccacaaggagaaagtccctgtttaatcctctgacaaaacagaacatcaatcaagctatggcagttccatctatttcatatggaagccaagtgtgggaaaagaggtacattctcacttaaccaatgatcaacatcaaactctgcatagaatgttcactctatttttgctttaaatgagttacactcatttaatttatagataaaaagctcagaatatttcattgaagataacctgtctatacagcaaggtgagtcagggccagggacactgggttccatcaacagaatggaagaggccgggtgcagtggctcatgcctggaatcccagcactttgggaggccatggcaggtggatcaattgaggtcaggagttcaagaccagcctggccaacacggtgaaaccccgtctctactaaaaatacaaaaattagctgggtgtggtggcaggtgcctgtaatgccagctacttgggaggctgaggcaggagaatcgcttgaacccgggaggcagaggttgcagtgagccaagatcataccattgcactccagcctggacaacaaagagcaaaactctgtctcaaaaaataaaacaaaacaaaacacaaaaacactagaatacaagagtgaggaacagctgcaaaataaattgcccatggctacaccaacattagtggcgaaacctggccagaatgcagatctctagatttcctagtagaggaagatggtgagaaacagggacctt

SEQ ID NO: 242 - DNA, 1425 bp, Artificial Sequence
  Description of Artificial Sequence: Synthetic polynucleotide
gctgcacacagagcgcagtgcatgtgtgcgtgcgtgtgtgcatgtgtttgtatgtgcatgtgcgtgtgtgcatgtatgtgcgtttgcatgtgtgtgtgcatgtgtgcacgtgcatgtgtctgcatgcctgcatgtgtgtgcatgtgtgtgcatgcgtatttgcatgtgtgtgcgtgtgtgcatgcatacatgtgtgcgtgagtgtgtgcatgcatgcatatttgcatgcgtgtgtgcacgtgtgtgcgcatgtgcgtgcgtgtgtgcacgtgcatgcatgtgcatgtgtttgcatatgtgtatgtgtgcatgcgtgtgtgcatgtgtgtgtgtttgtgtatgcatgtgtgcgtgcgtgtgcatgcgtgcgtgtttgcatgcgtgtgtgtgcatgcgtgtgtgtgcatgtgtgcatgtttgcatgtgtgtgcatgcatgtgtgtgcatgcatgtgtgtgtgcgtgcgtctgtgtgcatgtgtgtgcgtgtgtgtgcacgcgtgcatgtttgcgtgtgtgtgcgtgcgtgtgtgtgcgtgtttgcatgcatgtgtgtgcgtgtgtgcatgcgtgcatgtgtgcgtgtgtgtgcatgcgtgtgtgtgcgtgtgtgtgcatgcatgtgtgtgcgtgcgtgtgtgcgtgtgtgtgcgtgcgtgtgtgtgcatgcgtggcagttttaagttactagtttttaaagtcagcacattttcattgaatcaacttggtcaaaatctattacagaatttggaacccattaaaggaaagttcagtgagaagcccgtgtcttctcttggtcaacaatggaacttctatggaaatacttaggcaaagacttgagtttcctttgaccaacttctggtgttgaatctgctgaagcttgataggaatttgatcattctcggttagtagtttttttctgggtggaattgctttttcactacctgtgtgtaaggggaggaatcatctgtcctaaggacctggtggaagctgaaaggggctctgtttgtttctacagaaaagtgaagagtaagtctgtccctaaactgcctgggcagaaggccggcttctcccggcaaaggccacgtgacacatggagaattcaacagcaacactgagtaaatgtgttggaatctcacattttagtttcccagttactgactgtgcattcccacatttacaattattgaagtacgttcaagaatgtagagtgtgagctttatatagtcttgagcagtgccctgcttttaagagtgaattattttttaaatggaaatgagactcatctctcctggatctgaagcttgccgtcaactaccaggacctgagactcctcccggcgcttcccattttcctcaggaggaagccctgttgtttcagtgggtgtgtggtgaagggcaagttctcctagctgcacacagagcgc

SEQ ID NO: 243 - DNA, 1424 bp, Artificial Sequence
  Description of Artificial Sequence: Synthetic polynucleotide
gtacaatgttgccagtcatggatctgcctcacaggttcactgcatgtgaagtgtctagcacagtgcctggaacgcagccggtgctccttcaatggtaacttgtatgttaatactacaattattattgtatctgggtgatcttgggactcagtctcctcatctgtaaaatggggttaatgatgatcctgagggccccagctatccacacctgataccaaagtcctccccacttaccaccctctccctgtggctgctgtctgactgccctttcctttccggatgtctcaggacaaagcccagagagagggaggaaagaaggaggcaaggaaatagatatctcactgtccatccatcagttagcaatggtggcaccaattttcatagagaaggggaatgtgcaacgtagccagaaaaatatttcctctgtgactccagcagcccagctgttcccttccaggaaaagtgctgagggccaaaaagaaaataaagggaacaatgagagagagacaaggaaagaagagagagaggggtgagagggaagggcaaagcagttagggacaagaagggcatggggcgggggagcacagaggtgtgcaacgttttgccagggcctttcccgggctgcctggaacagcactcagcaaggctgccattgacccagcccctgctctgacctgccagctgccagcaggcccaccctgcaggaacctgggttcaaaggcaactgtgatccttagcactgtaattgtgcagactccactttgtccaccctctacactcacacctgccattccttcctgctagaatgtttgaccccctctctgcctgtcaggatcctacgactcctgcaagactgtctcctccagggagacccctgggattctgtccccccaccaccccccagctgcctttcccttccctccttgccattttcctccccccgcccaaaccccagtccaactgtgttagctcacaggccttcacttggctggggcttccgaggctcctgtttcagcctcaggcctgactccttcctgagctgggagcccaggcctcagacttcttggacctctttcccactgagtacttcagccagccaccctgagagaggagccttggtcacagccccacagaaagggggtctgtctagtgtccccaccagcaggtcccaaggactgagcccatggcctgctcttcacttgccgggggtagcgtctctctttctttttctcacccttcactaggttcatacctgatgcccctataacaagagacagattaacaagagaaaagcagacacatttatttaatatgtcttatgtgacacaagagccttcagaaatgaagacccaaagaaacaggtaaacttggatccgtttatactgagtttgatgaagtggataggcatgctgcacacagagcgc

SEQ ID NO: 244 - DNA, 1399 bp, Artificial Sequence
  Description of Artificial Sequence: Synthetic polynucleotide
gctgcacacagagcgcaggattctcaagttgaaagaaacaaattagtttgatagaatagtgaaaataacaaataccccagaaactgttaaactttcaccaagattctcagttgttaggactcatgtttttacagttgtattagaggcaaaaaaaaaaaaaaaaagataaatgcacttattttcagtccttcccacgcctaccaccttctttgtacatgtaaccagtttattctttgacacataattgtacatatttatcagctacatatgatattttccatacaatgtgcaatgattaaatcaaggtaattggcatatctattaccacaaacatttatcatttctttgtgttgagacattccaaatcctctggttattttgaattttatcacaaattattgtgtaaacagtttactcttgagattcgaattgaagtaaacctgaaacaattttattttttcaaacgtcttatgcttatgatagtcttcagtggagtggagaaaccctcctgttgattctagttgaagaaactggtatcattacggaaacttaatttcctattattgttggagtggcaatcacacatactgagggaatattcaacttgttttgaaataaatctcctttctatctcctgccatcagcttaaagaaaaacgtcctttgaataattgcctaaaacatgctatttatttctgaaattaacagaaagggcctgtttcaggattcacttaaatcatttaactgccacagaaaatacagaactctgaattacggcttttcttaaacacataaaatctatggataagacggttaagccctgctatcaaatcctcataaccctgtatgcaaataccatgcttacagaggatcttcatctacgatctaatatcttcatttttaaatgagctagctaaaggttctgagttcattattcctatctctttattctcattcaaattattatgttaacattaatctatttattagaacacctttcagctaagaaaattaaggagctttgacaagcacaaactaaatattccctgaagagtaggttggcacaagctaagatagaatgaaaggtaagacaaaaaaacaatgtagaggttcaattcctttgctcaagctcaatcagggaaacagtcagtgtctactttatatccaacaggttaaccctttgcaaatgaaagactcaagtggccaaatgacacttacttctcagacaaggtgtttgcaaggataaactttgagacaagagaactagccttaaattgaagagttcctgacaacagcaatttgacaagcacctaactggattatctcttaaatccagtttataattggtccactcaagtatgtattttataatagttattgacacatatgatatagtgctg

SEQ ID NO: 245 - DNA, 1395 bp, Artificial Sequence
  Description of Artificial Sequence: Synthetic polynucleotide
gcgctctgtgtgcagctatttaggagactagcatgggctggaaatacagttttgggaggtgtcatggttacaaccatgataatatatggattagacatccttcctaactcttccactgatttgatttggggcctcctgtcaccttcaggatagagcccaaaccactagtcatggctgccaggctcccagacacacttcccttttccagcctcttctcttggccctctccacttgtagtccatgccgtagactgtgcaccctggacagtgtcacatagagtgctatgggggtggcaccccctgaagttcaacagcacggaagccctgactggtatgacatggttcaatgtccagagtttaattttaagaatcaacaactagacaaagtaatgatattgcatagtgggccatagtcagttactttaaaaacaaacaaaaatgtcacatttttaccagcaaatttagtatgtgttgcttggatttgggtcattctcaaagctgcaatagacatttatatattctattatttacaacatttttctccctttaaccttcactataatcttttgggtatggtattcatttaataccattctcaggtactaaatgaaatgaggaaaccaacattcctcaagtgtgaataactaattcaagacctcatgaccagacagcaaagaaagagtgtgattccaagattccaactgcaatttatgcccttttctcatgatttcatgttgccactctcattatgtattctttaagtaaaacttgcaggaatcactttatagcaatataatacttgaaaataggcagatgaaacataaattgtaaaaaaaaaaggaagaatataagcttttccttatctgtgtaatataataatgtcaacaatgtatgggttgtttttaggcactgatgtcaggtttaaagtaaagcaaaacaaggattacttaatacaattttaaaaaaggctaaaagtatctgatgcactaagatgaataaatttaaaatgtcaaagttcacaatccatacgctccagcaatgtaaactgaggccaaaataacacattttttgagatttattattaaatattatggcttatacaggataattaaaacattgtgtgtgtaatatgtagacactaattgtcctaccattccaacacatgcattcgaggttagtcagtgaatagtcactctccagttgctcggcattactgcattagtaatagtaataataaagcaataaagtttattatgcaattattacattacagatatttaaatgtagatttagatagatagatagatagatagatagatagatagacagatagatagacagatagatagatagatagatagatatccctcaaattacatagctgcacacagagcgc

SEQ ID NO: 246 - DNA, 1393 bp, Artificial Sequence
  Description of Artificial Sequence: Synthetic polynucleotide
gcgctctgtgtgcagccggtatagctatatttcaactaggattctcccattatcccaccttcctagtgatttttctttttttattttgagacagggtcttactctgtcacccaggctggagcacagtggcatgtgctctctgcagccttgacctcctgagctcaggtgagcctcccacctcagcctccccagtagctggggctatagccatgcactaccatgcctgcctaacttttgtattttttgtagaaatggggtctcaccatgttgcccagcctggtctcaaactcctgggctcaagccatctgctcaccttggcctcccaaagtgctgggattacaggcatgagtcaccactcctgtcccttcctagtgattttactcttcatcatgaagtatattcttatcattttaagtgactaaataaaggtagtgtcttctttaatgatgagatggaaatgtgatctattcatatcagaaggattttaatatggattctaatatggaactaggaccttccgtatgcaggactatgtccatggaatctctcattcaccttggctggtgtccggatagaacctcctctggatggaaggcaggtcttgacacttgcccaagttgggcaacacttgcttggtccccaatgttggtgaaatcatgagccaaagaaggtcccctctgcctcttccagcaggtagcacagctacagctcaagtctcgtcaccagaccaatgttacaaagacacttttctcacagttgttaggtcagtacacagtgcttgaacatcaaatatgaaagtatacacacagtgtgacctgaactctgtaaaaaagaatccataggctaggtgtggtggctcacacctgtaattccagcactttgggagaccgaggtggggagaatcacttgaggccaggagtttgagaccagcttgggcaacatagtgagaccccatctctattttaaataaaagaaaactttgtccaccaacgggaagtcaggataaagattttctactttgggccagtcaaaccacatctggaggattgagatcaattctgggtatcacacaaagacattggtaaatttcatcctgccactaactggctgggtaatttgggtaagcaatttaagtattctgagcctcatatgcaaaaggataatagtagtaccttttgcatagcagtgttgtgagaattagtaaaatagaaatgtaaagtctttatatctatatctgatccgtaatatagtcaagaatggtagctgctagagaaacaactagaatagtgaagtctatggaagctcagatacttgagaaacacaaatacttacaccaggaggaagacgaaacttagaggtcacaagatagctttcttggctgcacacagagcgc

SEQ ID NO: 247 - DNA, 1371 bp, Artificial Sequence
  Description of Artificial Sequence: Synthetic polynucleotide
gctgcacacagagcgccacagagattgctgtttcccctcggtcactgcattcagaactcatgtgccctatctgcctggacatgctgaagaatacgatgaccaccaaggagtgcctccacagattctgctctgactgcattgtcacagccctacggagcgggtaataggagagacatgtttgagatgagatgaaggggtacaaagttagggccctctcactggtcttggttcagcctaggcttcagttcccttgactgaccactcagggcttcccttctcctaccccaggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacaggtgtgagggtcaggagagaagcagaactgatgggatgggtccgtgggtcagtccttgttgcctgctagcttctaagcctcagcatcctaggagctgaccacagactgatcattagggctggaaatcatgggtgtaaattgcagtttcttagtaaacaactggccctgctcttcttaagaaaaatatagggctgggcacagtgactcacatctgtaatcccagcactttgggaggtgaggatgggaggatcacttgagcccaggagtttgagaccaccttgaataacatagggaaatctcatctctacaacaaattaaacatttagctgggcatggtggcacatgcctgtagtcctaccttcttgggaggctgaggtaataggatcacttgagcctgggaagaaagtggatgttgcagtgaaccatgatcacaccactgcacactgcactccagcctgctgggcgacagaacaaggccctgtcacaaaaaaaaaaaaaggaaaaatgtagtttaccccatgactttctagaagttagaacagtagagcgattttgagaataagccccggattcatactgctggaagttaaatcacctcctaggccagcatctctcagtctttcatgtgtatccagattacctgtagatcttcagatgcaaactgtgattcagtaggtctagagttgggcccgagagtctgcatttcacaagctcacaggggatgtgtatgctgctaccgcactttgagaggtgacagcctatgatcactaacaagttacttaacctctctaagcctcagtttccttgtctttgaaatttatttaataatactgacttcagaaagtgattgtgaggattcagtgagatc

SEQ ID NO: 248 - DNA, 1369 bp, Artificial Sequence
  Description of Artificial Sequence: Synthetic polynucleotide
gctcactgcaacctccgcctcccaggttcaagcgattctcctgcctcagcctcccgagtagctgggattacaggcgcccacacccgactaatttttgtgtttttagtagagatgggattttgccatgttggccaggctggtcttgaactcttgacttcaagtgatctgcctgcctcggcctcccaaagtgttgggattacagttgtaagccattacgcctggccaccatggatgttctaaagacttttttttttttttacacggagtcttgctctgtcaccaggatgaagacattttttagtacttatcacattgtgttttagttttttatgtctctctttttagactgtgagctttccaagttaaggtccaagtctcgtatacatttttttgttttgttttttgagacagaatctcactctgttgcccgggctggagtgcacaatctttgctcattgcaacctctgccttccaggttcaaatgattcttgtgtctcagcctcctgagtagctgggactacaggcatgcactagcatgtctggctaattttcgtattttcagtagagacgggattttaccatgttagtcatatatatttttatccctagcacaatagctggtgtatcacaggtgctcagtaaacacagaataaaattaaatttaatacataaatggaatgagggatgaattattgttggccagacatctgagagtatctgccatggatttttctctattattttcccagaaaggaagttgtgtttattttgttgagtaattgtcatagacctgggtctgaacaactagatgagaacattacaaagaagcaacgctatttaaaattccgagctgggacttcattttattcccatcacagcagactctcagtgctaaaagcaccaaagtaagctgtacatgtctctacaggattgcaaaggaactaaacagaaaggaagggaaagggagggactttcttaattacattacaatcatcatgaccttcattattattgatgaattatcctctgttggtatgaggagagaaagaataagaagaaagtaatatgagagaatgaaagatttattggaaattgatgaaattaatcaggtttgaaaaaagcactgttgttttgttttgtttttttctttcacgagaatatcttctcccttggaagaagctctgggaagtctctgaagtgctccagagttccatcttctctctgtggagggagaaaagtggtattggaatgggccagctcagatacaagagcctgcatctgggctcttaggaggcctagaaatacaaagagataggctacagagaatggtctgtagactagccccatgcaagtgctgcacacagagcgc

SEQ ID NO: 249 - DNA, 1361 bp, Artificial Sequence
  Description of Artificial Sequence: Synthetic polynucleotide
gctgcacacagagcgcccattcttttttttttttttttttgagacaaggtcttgctctgttgcccaggctggatggagtgcagtggcgcgatcatagctcactgtggcctcaaactccctgctcaagtgatcctccagactcccaagcagctgggactacaggtgcgcaccacgccgccaggctaatttaaaaaatttttcttttgtggagacagggtctcgctatattgcccaggctggtttcaaactcttgggctccagcaatcctgtcgcctcgcctcccaaagtgctgggattacaggcgcgagtggccgctggggttcttaacttgggtctttgaatcgccttaagaagtgtctctgaatctgggaattgcaagcaacgtttctgtgaggaccttcacacagttcatccactcttcgaagagtatggaccgaaaaaggcatagagcattcactgcacgtagagaaaatcagcaacccctgctccccaccctcagcctgaggtgcctacctccacgtggggtcaggaggcggaagcgaaaccagaagaaaaaaccctgagatctataaggcagttcaggtccctagtgacatgagctaaagagaacttggacgccaggactgtagcagacagaatccggcttcggggttcgcatcagtcgcacggaaggtggaaatagcccccaagttgtaacccgccgcggtcttccctcaacagcgcaggcgccaggactgctaggacgccgcgcacctcccgcgatgccccgccccggcgcgaggcaagacgggaaagtcaagatggacgcgtccatttgaacgtctcgcacgccttcctgccattagcactcgagcccgctgctgttgcccgttcttcctccggaataggggagggagagggaatgagaagctgctgcggcccaagagtcactgtgaaggaccccgccgctgccctcgggcctcctcggcccctgcgcctccggggagcagccggggctcgccgcgcctgacgcgtcccgagttatacaggtgcgggcgccgtaccgcagcacttggtggtctgtcgcgcgccgcgtgactctcgcacccgtcccgaggccgagcctcccctggtggccgtaggtctggaaacccggggtactgggaacccgagggagggccttgagcgtgctccggggctgagggggcctgcgggcgctcctggcctgcgggctggggtgctccttccggctcctgcttgccaacctctttcctgagctgtgcgtagcatcccatgtgcagcctcagcttctagactggcctccagcccctctgagctgtttttctgagcctcgggctctcagcctgttttcaccgtcctct

SEQ ID NO: 250 - DNA, 1352 bp, Artificial Sequence
  Description of Artificial Sequence: Synthetic polynucleotide
ttatctttctcaaagataaaaaacagcaaaagggaaaaaaatgtcctgagctttgtagatgaggcaatctttttacagtaatttctttatctgaatttatcagatcaacaaagttgtttagaaatgtatgtccactcacatcttcccatcttaaaggtggtttttcttagaaataaataaaaatgaaatacatccaagacatccctcacctccctctaccacaagcactagcggcttcttgttttgtccattattgtgggcgagggatagtgtctgtgggtttctgggctttggaaatcttgaggtgggtctgagagctctgcagatcaaagatgagattcagcccttccaaggaactaccctctttttccaaaatgaactttctgttcttggcagtgtggggaaaatagacttctagattagaataattaaatatctgacccacaactcccccaaatgcctgtggcttcttgggctttgatgtgggcagcttactgtagaacggaaaagtacagcgtcttctcaaggctgtcagcatctgaaagcgaggaaggctaacagtgaagaactccagggtctctttcttgaaaacagacaggacctcatccagagtctctgggcagtgggaatgtgaacaggcatgaatcttgcaggtgctatgccttcgcttggccaatacgtgggctgcacagtcttgtctctgccaaccactgcagccttatcttgaatccaccatctctcactctgttcaccttccttggcctttcccaatttttccttcttgcttttctcgctcccaccacaaagcctttgcattgggccattctctctgctagaatgctttcacttcctctctcatatatttaggtcctattcattattcagctctctgctcaactgtgtattagttagggtaggatgagctaagctgcagtaacaaatagaccttgaaagctcaatgacttaacacaattagtctattttttgctactttttttttttttttgagatggagtttcactcttgttgcccaggctggagtgtaatgacatgatctcagctcaccacaacctctgcctcctgggttcaagcaattctcctgcctcagcctcccaggtagctgggattacaggcacatgccaccatgcctggctaatttttgtatttttagcggagacgggattttaccatgttggccaggctggtctcaaactcctgacctcgagtgatccacctgccttggcctcccaaagtgccgtgattacaggcgtgagccactgcgcctggcccactgttagatttttaaccctaccagatattcgacttgactttatcagctgcacacagagcgc

SEQ ID NO: 251 - DNA, 1347 bp, Artificial Sequence
  Description of Artificial Sequence: Synthetic polynucleotide
gctgcacacagagcgcatgctgcacacagagcgcttcagcttttatccatttaattcacatatcctctgaaaagcaaatgaaaagaataagagttctcatctacattttgtaggtggaaaggagaggtacagggcaggtaagtaacttattgtggtttcacagcaggacaagctaggcttatgatagaatttggatatctcatcttgggctcaattcaacagtcctggtttggaaaacattcattattaaagctctaaaacaaaacctgctattttgcaagtgtcaagtgatttctttattcaagaaaagatggattgagagacataaaacttactctttgtttcactgtgaaaagatgctattcctagattctccagggggaaaaagctgctttaaaaaaatctggggaggatagcatgttagcaactaagaatctttagataaatatattgtcaattatgcccatttttaaggtagctacataaaaatacagttgttttgaaggctatcctgaaaatcatataaaatgaactcctttcatagttgattctctgacagttcccagaccctgcctttcctcttggctccctgaaatttgtgctaagagtatctggagagccaataaagaaatgctttctttttattttggagaccaagtctcgctgttttgcccaggctggagtgcaatggcatgatctcagctcaatgcaacctccacctcctaggttcaagcgattctcctgcctcagcctccagagtagccggggttacaggcatgatcccccacgcccggctaattttgtatttttagtagagacagggtttccccatgctggtcaggctggtctcgaactcccaacctcagctgatctgcccgcctcagcctcccgaagtgctgggattacaggagtgagccaccgcgctgggcacagcctccaccttcaacctgcacacttccactccactttttagtttagtctgccaggatttcactgttatcttttcctctctcttcacaatttcacctctaccacagtcaagcccgaactctgccggtgggaatacctcacggaacgcaatgatgacttcctgaggcctccttctcagtgcccagcccctgggacagtcctttacttcttcctccttcacaggctcagagtgtcctcatctcccaggcgaggccctgtggttttcctctttaattattgcatgtatgttgtcatgatctgaattgtgtcccctcaaaaatatgtgttgaagtcctaacccctggcccctgcggatgggacctgatttggaaatagggtctgtaatcaggttaagatgacattgtggaggatttgggt

SEQ ID NO: 252 - DNA, 1321 bp, Artificial Sequence
  Description of Artificial Sequence: Synthetic polynucleotide
cactgcactccagcctgggtgacagagggggactgtgtctcaaaaaaaaaaaaaaggaaagtagtagaaggcatagacatggagtagttgggaaggagattcaaaaggtagacaggatctgtgcggtataattgggagccatttactgtacagtgcctggacttagcaagatagttaaatatatataattgggctttgcaacctgagtaattccttctagccacattgttttccaggacttccagcttcttcctttccaatgtcaactttgcctacatatggagtgcttttgtagaactcctgcttgcaatgaggtgccacttaaatctgaactctccttcagctccttttcccatttaaacttctctctcctgtgtccatttcttgtaattctgagtagtaatattttatggatagtagtcgttcaatacattctcttaacaagttaacaaagccattgttgttatactcctttgtggtaaagagagacattaaatatgggaatttcagtgttcatgacaaaccagtgggagagtaactgaagagataatatgtctttgagttccagagaattggtaaaaaaatagtttaggatcattgacaattaaatggtggtagtaatactgctggaaacatggtttgataaacacaatacaacagttttagaaatgaattgaatggttggctgatacaaatattatgaagttggaggtatttctttaatttcttaatgagtcttttagagctagccagcattagtagcaatacctggtgataagcctattgcttgagggactgtgcccagaatcttccaggttaacacttttccccagcagctaccacagacacccatggtcttttcttcccttagaacttgttactgtcctaaacattctgttacattgctagctgctatcaatgaggttcatcagaagactctaaaagaacatctttggcattgatgagctaaacaaaactaaaatggtgaaatacttcccctttggtatgaactgatttgtatccttccaaaattcatatcttgaagctcgacccaccaatatgattgtggttggagatcaagttttgggaaagaaattaaggttagaagaggtcataaggaggccatcatggtgggattagtggctttgtaagaacagagagagaagttgctctctcttcctcatgtgaggacacagcagggtggccatttgcaagtcaggaagagccctcaccaggaattaagtcagctggcaccttaatcttgaatttgccagcctccagaactgtgagaaataaatttctgtagctgcacacagagcgc

SEQ ID NO: 253 - DNA, 1318 bp, Artificial Sequence
  Description of Artificial Sequence: Synthetic polynucleotide
gctgcacacagagcgcccatatgtgcaacagtgcctgcatgtaatagtcctaagtgtgtggacttgtcactgacaagtgttcggccagcattgtgcaccttgtgtggcgcgtctggtgccgtgtttttatgtcactgtaaataatactacccagtacgttatcttgggagggcttctcatcctgagcatttaattgtacggtatagtgctggattaggacagagataatcttggcttctccctcttctcacctctaaatatggcccttaaaaaaagcaagcattttaaaaggcatatattttctcatttattgtatggatatatggtaacatttccttctttccatactctgaagtagaacaaaggcaacatgctcagaactttaaaaaaaaaaagatgtgttaatggcattcagagatgcagttatttgccctaagaataggtagagctctgaaaaatgtcttgtggtttgaattttactgaaaaattggaaggatagcatcactactgtgaacttttctatttggtattattttgacttcaaaagctctgaattttgagattaagtatacaaattcttaaaggataaaaatttaaaggagatctccatgtatcatcaagagcttatacatcacttagatatggccaagattataatattttggaaggtgtattctcaaacatgagtgtttgtggagggatatggggaaatattggatattttcccataatcagcaaactttttctgtaaaaggtcaggtagtaaatatttccatctctttagatcatacatagggtctctcacattcaactctgtgattgtagtgctaaaatagccatagacaatatgtaaattgtagataaggctgttccagtaaaactttatttaaaaaaaaaaaaaaaaaaaacaagtggagggcaggaattggcccatatgggctgtggtttggtgacacctgctctagatcatttctatattcttactgtaattttagttccagcttcttttatgtaatggaaaattctgggtttctatactcacagaccccttgtttggggaagcaaagttctcagtaatgatattcctgatccatgtctggctttaatcagtaattgagcaggacgtacaagagtgagactcactacagatgtgcactgtgcagatgtctgctgataagttctgtgtagcaaaaatgcagaacactggaatgtggctggggctttctgtaaggaagcatcacacttcattgtttatattagcttttcatatagtatcttttatttaaaattttttgtgggggaggggcatatacagata

SEQ ID NO: 254 - DNA, 1317 bp, Artificial Sequence
  Description of Artificial Sequence: Synthetic polynucleotide
gttgattttttgatctacgaaacttaatccccactgtggcagtattgagaggtgggacctttaagaggtgattagtgcatgaaggttctgccctcatgaatgggttaatctattcatgggttaatagatgaatgggttatcatggcagtggaactggtggctttataaaaagaggaagtgagacctgaactagcgtgtttgacccccacaccatgtgatgccctgtaccacctcgggacttggagagtccccatcagcaggaaggctcttgccagatggggccctatgaccttggacttctcagcctccagcactgtaagcaattaatttccttttaaataaattaaccagtttcatatattctgttataaataacaaaagatggactaagacagtatgtatacatatttgtgtggccacactgaatgacatgctataagagtaaagaagacgtaaagaattataggtgctcttcctgcttaggatctgccttatgggtcttaggaatgggaggccatctggtttaattgttgtttgaaaatttaggaaagaggatgaagctcatgaatgcagttcctactgatacaggaattaagaagaaattatttaggcagatactgagggtaaggaagtcctctgaagattttccttttaatgaaaggcagcccaaaatcattttcttttctaacaaagagcagcctgtaaatcgagatgtaaacatagacgagcaacctagaagtttgcgtgggtgaatgctgacagttgtgccactaagaaaaggctatctgggactagggcgctctgtgtgcagctattattacataaaaccacaagcctcctgggctccagatccagaagcaggcaaaactggccacagggctgccacagtacactactataggggcagcattcatattgctgggttttttaaaaaaatatttttatttttctctttagaaaaaaaaggacagacacattgttatctatgtgaatggcctctcctggagcacagctccattggagggagggaaccagtttcattcataaagcagcctagaaaacagtgtgacaaagttgagaatgctgctgatccggactgtgttggtatggagctgcatgtatgctggagtgaacatttgtcatttgtggctgcttaatattttgaccactgccatggtttgaatgatgcctccaaaactcatattgaaatgtaattgccattgtgatggtattaagaggtgattagtcatgcaggctgtgctgtcaggaatggagcaatggtattgccatgggagtgggttgctgcacacagagcgc

SEQ ID NO: 255 - DNA, 1292 bp, Artificial Sequence
  Description of Artificial Sequence: Synthetic polynucleotide
cagaggaaagatgccacctcacatctggagcaaatgattcccaccagatcctggtagcttcaccaagagtaagtacaccagtcaacctgtgagtagaacacatattttgcaaagccatgttgggtggagaatgtcacaaaaaatagcgtttccagagccagagatactttcaggggtggagaaagacaagcacagagggttcccctaatggccagaggaccgccaggcccagataggaaaggtctttctcacataaggagcagcacccggggtgccaaggtcattcagagctgaggacttgcagccctaagcacaaaggcctacaggtggaggaactgagttgttcatcaggcttgacagctgcagcagtttgagactttcttgggttggaatttccagtggagaggaaaggaactaaaagataatatccttggaatctttggagtgtcacaggaattcccggtggtgagagtggatttcatatgagaatgtagaggagtgggcccgaaagtccctctgtctggtttgtttttgatttttttattattattattatagagacagggtttcactatgttgcctaggttggtctcgaactcctggcctcaaacaattcttctatctcggcctctcaaagtgctgagattacaggtataagtgactgcaatcagccaaaatgtaaaattaatgatgacttagtgtgtattcacgtgcttacagttaaaaactggtcattttttcaaatgtttatcatattcatattcataagcaatatgacatgtcttcaaataattcagaataccactgttgctattcaaaagaagaaatctccctctattaaactagggacttcaagtcttggtctttactcattctctcttccttcacttccttctttcctatctttgggttcctttaatgaaatgttctccatcccaggcaggaaaaccatttccctgaaaaatataaaatccactgctgagcgctgcagcgagaattaaccttgattaccacagtaatttactaatcaaaactggagacctggtaatcaagctggaattgccagctgcttgatttttatagtaacataaccaagatcgaacatttggtaaacaaggggtgtgggtgtgatggggagactgggacaaggtaagggaggggcagggctgtcccagggctggaaggaggctgacatgtgctctgttgactgggcagcaggaacagcagacaccgaaagaaatgcagaaacagacagaactgcagaaacttcctctgagctgcacacagagcgc

SEQ ID NO: 256 - DNA, 1289 bp, Artificial Sequence
  Description of Artificial Sequence: Synthetic polynucleotide
aggtgatccacccacctcggcctcccaaagtgctgggattacaggcatgagccactacgtccagcctaattctttaattcttaatgagtaagtgaaattgccttaatgacttgtagccaggaaacactcaggctggtgtttctcttcttgttccaagagttatggataactaccagctgcttctgatgacactgttagacaatgatcatgtgaccacaggggtggctctgatggaacccagatgataatcccatatgttaggatcaattccttgctagattcatatgttgctttttgtcaaaaagtcattctttagaagctgcagtacttcctgttgtgttaagggcctctctacccagtgaggagaccagacctggcctgatgagctgcgtgagccctgcccctctgtctttatttgggaaatggggatagtgacgcctatgggacctccctcatggggttgttgtgagtctctgtaaggtcatccttgaggaagagctttgcaaagcatcaagaaccaatcaggtaatcccttacatcaggaatctggccggacgcaccctgtaggccacagaaaatcaaggactcagatgcctggccacgcctccttaggcagcagtcctgatgtggtgtttctcagcagctctgccttctcacagccctcctggtgtgagcagagttagtgccagcgttaatagtgtttattttagaatcaacacatccctatacctcatcatgccacaaagagaggcatttaggctggaccattccacaaatatttatagaacacctcctaggagccaggcattgttctactctctgccaacaccaggagaacaaatagatactgtccctgctcgtatggagcccacagtgagggagagaaagacatgaaaagcaacagcacccgtgaacaacccccacactaataaatatgtgactaagagctgtgacaaatgccgcgaggggaaaacggggactgtgaagagagattatgtggcaggagggctggaaacagatggcacttctctgaggaagtggcttttgggctgagacctaatggcaaatgggagttagagactttggcaaaaataacagccacatgaaggaagacccaaaggccagcattgtccagttttatgatcaaggggacggtggtggcagctgatgaagccagaagggacagcagacatcaggcaatgcaaggtagttctgtggtggtgtgggtttcacctgacgtgcagtggagtccacagagtgttaattagcagtcgctgcacacagagcgc

SEQ ID NO: 257 - DNA, 1284 bp, Artificial Sequence
  Description of Artificial Sequence: Synthetic polynucleotide
gctgcacacagagcgcaaagaaagaaagaaaaaaaagaaaaaattacaccaacggaagtacatagacagcattaaaaaaaaaaaaaaaaaaagaacaaaggtgaaggtcctggatcccacagctcaccaggagcatgtccagcatggcccatggttgaaggcccgtctcccactccctcatatctggacaaaggccatggccaggggcaaggaggcccatgcctgaaggaggcctccaagctggttccagctcctcacgccaccccaatgctgtgcaacgagccatcagaggctctgcccacacaaatggcatggccatgccacagccacagagagtggaaggtgactgcccttaccatctcctgggcaccacaagggatgtgtgaggactgacgcacaaggaactcaggggcttcccactcacggtgctcagaagacagaccggctgggcggctccccagtcgctcaccatgagacacacccttttccaaacactttcccttccatgaactttatattttgaaagactgcccttccatctaggtccacagtcctgatccccagaacaaagctgttcaatcaatacttcctttccccacttcatctgggtcagaggctgtgtcacacaaaaggccaggccacagggctcccgcaaggcagctcacgggcatggccacctcacagggcctgcgctacgaaggcctggggaaggtccaggttcatccatctccctggtccaggctgagtccccgggtcccagccagcacccatgcaaagtaggaacgtgactggttctagtgcctgagctctcaattcctgagctactttcaacaacatggcagctaagaaagtttacaccaaaaagagaaagctagtctttttgttttaatctttttacccagcgtaggtaccaggagggatctctgaaaggcaggttactcctcgccaggagtaggatcaaatcatgagcttattttaaattggcccattctaggtacagtcttggccaagtctggatttgtaatttagcagaaaagaaacttaaatgtcagtgcccagtgctggcactggtgatgtgaaataggcaattccagacatttcagactggagattgaattgatgactgtgtgctgaaggcaatctggccagacttatcaaacaactccaaaatatctgggcttattactactattactagtatctccacccccaaatatctttgagacttactaattttacatatgggaatctatgcttaaataatgactttgagatatgacatca

SEQ ID NO: 258 - DNA, 1247 bp, Artificial Sequence
  Description of Artificial Sequence: Synthetic polynucleotide
gctgcacacagagcgcttagtagatcatgaggtctgcccacctcggcctcccaaagtgctgggattacaggcagctctaaccatctaagaaatcaaatatacaaaagataaactaggtttacatggtattgaaggcatgtacaggcagtcaacataatagttgctgtgagaagataatacaaatcaaaggctaaagttgctcttccaatttgaagaccaaaaaactaacctctcacctgaatggattccctgacccccaagtcatcaaccaaaaatgttcaggaaaatcatggaggaacgtgccttctggaaacaggcttcatttctgccaaaaatgatcatggtctacccttacctaccaatgtatcctagacagacactcaaaggtcctatcatcaggctaaaaggctagaaacatcaacaaaaaatattaacagcaaacatgtgtatgatatgccagcactggtataagcattctgcctatggtaattacactaacttatttaagacgcacaataactctcctgagggagatactgctaccatccccattttactgataaagcaactgaatcacagggagatcgcagcttgctcaagaccacacagccagggagtggcaaagctgggattcaaacccaagcagtctggctccagagcagggctgtttgccgtattgcctctcttagagcactaataacaaacctctgctgcctgcatccgagcaaatcacccagctcaggtggagactgcaggcaggcaccttcttggatgaagaactaatccctcctgggttaatgaggacagagaaggggcagagtcacaggaagcatgcatgcgcaggcctgtggaccctgggggatggccatctcaggggcaaacgggttgcactgtagagcccacaacgagttcaggtcaacccctcggtctgggagcacccagaaccaggaggtgagagaacagctccctctcactggccagctcccagaggattcaaacggactatcctcctgaagtgtcatagcccgtggccatagtcagcaggtactgattccacaggtgctatcagagctgtcccagggctcccgtcccaatccctctcaaggtaagagttccctgaagatctgaaccatccctttctgacccataagggcatctttccctggctttatgggacagagccctcccacatgcttaccttagtggaagacaggcagagctttccagattatgcccgttttatagac

SEQ ID NO: 259 - DNA, 1178 bp, Artificial Sequence
  Description of Artificial Sequence: Synthetic polynucleotide
gctgcacacagagcgcatgaggcaggagaatcacttgagcctgggaggcggaggatgcagtgagccgagatcgcaccactgcactccagcctaagtgactgacagagacagacattgtctcaaaaaaaaaaaaaaaaagataaatggttcttaaacatgagaatggcaggggaagttggaaagttttgttgtagtgagtacagatttgatttggttactccacgagagtcattttagcaccaagtatattaaatgatgacatgaagaagagcttcatatgctgaagagacaactgacaacccgaacttccacaggttctcaccttctgtggcttattatagctcattttcctttcagatcttacaatctcccactttaggaactgaaattcttcggaatttcctgtgattatgttttctagtgttacgggaaggaaagttatctttagggttagacaacatgtaaagttgaatactgaattcaacagagatcttaaaatacaagtccaggaatgaaagggattaagaatgtacactgtgtatagttaatgtagactataactaggttcataaaacaattgtaaaaattgtctttgaagagaaagtttattaacttcattttaatattcacaatacagatttgagacattttatgggagaaaaaccacaaagttctaatcctccttaagaactaggatgtgtctcttcattgctcacaggctgcgaattaagctttcaattcattcaacagtgagtacctactatgtgccaaaaaatgttgccagcagtgggaatgttccagagaatgcccttgttcccatggggtttacaacctagtgagtgagacagttaatgtacaataaagaaataagtacaagatctttatacaagattataagattaggcagtgccgaatgttaaaagcaaaataaaacagggctgatgtaagagttaatgataattcttaactacctcccacacaaatgagcttctaaggactttactattgaatttgtcatgtctttttgccttgtgttgaaagttacatatatagcatcaccgtatacagcgtattgttactgtattcctacactttcctatttatatgtttaagttgtttatgtgttttgaaaatttagcataacacaaatttgagttattatttgtgcatgtgaattt

SEQ ID NO: 260 - DNA, 1177 bp, Artificial Sequence
  Description of Artificial Sequence: Synthetic polynucleotide
ggaattacaggcgtgtgccaacacattccgataatttttatatttttagtagagatggggtttcaccatatcggccaggctgatctcgaactcctggactcaagtgatccacccacctcagcctcccaaagtgctaggattacaggggtgagccactgtgcccagcccagattttttttttttctaagagacagggtctcactgtgtcatccaggctggagtgcaatggtgcagtcagagctcatttcagcctaggaagattttaaattgcacaacagctagaattagagcttttgaatctcttagatctgaatacaagctaacaaagcacacatcttatattaaatgtcattcttaacatagataacaatccgtggataagtcaaaaatagaatcatgctggcttacctgaaataaagaaaaatgtaaatcataacacagaatccacgtatgtgttgaatataacagtctccaatgcaattcttcagaatttttactggagtagaaagtaaaatctcacatgtgctctatcctcattaaagaagaaaaaaacaagaaaggatgaccacagcatcctccctcctttgccttagctttctgttctgacagtcattcgatggtacccaatgtctgttagaaaacagcatgctaaattagaaaaataaataaataaaggcagcatcttacatgacagctccatctcctggtcaaaagtggaaccatcttaattcacgttcctttggctatgtagcagtcagcacataaaattaaatgatgtacagcccataattccactctatttgaaatcaactactttaattaactgtaatttaaacatttaagaagaattatagtatgaatttttagaattataattctattttggggattcaaatttctttacattatgtttaaactaaatggaagcttttcccatcattgaaaacttaagatttatttaactttatataccatctgaaaaagtaatatgtatctcctataaaacaattttagatgtcaagcttattgataatgaacatcacatctctttgtggagaagtataagtttttgtcactagagaagttaacacataacacttgtgttgctattgtttggaggaatgttgaaaggttaaagataaggcaggaaaattaaatgaggctgcacacagagcgc

SEQ ID NO: 261 - DNA, 1156 bp, Artificial Sequence
  Description of Artificial Sequence: Synthetic polynucleotide
gctgcacacagagcgcacacagagcgctaggaaaacaggtaaagggagtgctattatgttcaaactgctttccagagacaatattctataattccattgacaaggtgtatttttagagcatgatataggacttacttcatgagatgaaagaattataaggtatgggggctaaggaataatttcaattcagaaaatagaacagaaagaaaatattgtgaattttgcccttattgactttatgaagaaggaaagacattccttaaatcattagtcttcaaccaccctaattttcttattattgaaatagtctcctggaatatagaggctttaatgttttttcatgtaaaaaatgtagcactttagttgtaatgctagaatttcttgtaattattgaatgctaatttttccttgattacttatgtatactcaatatcagtgtcacattatggtatttctgcaatatgaaacattaatattaagcatatataactgataaccaaaattaactagttttcaaagaattataatgtattgatggtaaggagagtggtagaaatgagatgagtggtttgtttcagaaagcacaatcacatttactttgtgtttgatgctgaaaaacaatgcttgggagaagtcaaacgttatttctttctgatgcaagaagcttaattatgattaattactgtactggttttctagagctgccataacaaagtactacaaactaggtggctaaaagcaacagaaatttattgtctcacagttctggaggttagacgtccaaaatcaaggtgccagcagggccatgctctctctcatggttttaggagagaaatctgccttgacgtctagcttctggtgttttgtggcaatctttggtgatcctcagcttgtagatgcatcactgcaatcacatggcctgccttctccctgtgtgtcttcacagcttcttccctgtgtgcatgtctgtctgtggtctaaattgtccctttttgtgaggatgccagtcatattagcttagggctgtattaggccattcttacattgctataacgaaataccggagactgcatgtattagtttgttttcatgctgctgataaagacatacccaagactgggcaatttacaaaagaaagaggtttaattggacttac

SEQ ID NO: 262 - DNA, 1130 bp, Artificial Sequence
  Description of Artificial Sequence: Synthetic polynucleotide
tgtattttcagtagagacggggttctaccatgttgcccaggctggtctcgaactcctggactaaagcaatccacccacctcagcctcccaaagtgctgggattacaggagtgagccaccgcacccggccatcaataattttttaaatgccatgggtcattccaatgtggagccaggggtgagaaactgttcttgaggaattaagagtcgcaatagtcaaatatgccccatgttcctctcagaaactatttcagatcaagccagtttacttggtttctagaggattcatagtaatatcatattccaaaagatcgttccagaacaaacggatgaattcttgataacctgttgttttgatcctcagtgaaccttgtgtctcaggtctactggacccaactctcacagtgggatgagagtggggtggagtttgagggatgtttttacatctctaatgacaaaagtaggattttctgctcaggaattcctacacctgtccattctgaactctgaatgagaaacaaaccaacaaataccaggtctgcatgtggattcaaaatgagtgataggtgcacctttgatttagtaaacattcagcccccaggcaaatcttttttctatcttcatattccattacaggatagatttatgtttattgtgacaacccaaagatatgacagactctcaggtattctctggaacagtaggttttgtacaattatgatgcgacatccataatattattcaacttacttgatgacatgtcacacaaactttaacactttataatggcacttgattagtaacttttctttctccccataacagatcatgccatataacagagagtttactacacacatagctcacataacatcagagtagttgtccttgaattgttcatatgttgggttttttttggttgtattcatgcttcttgcagtagttttatctgagctatttttattttctcaatatgtaggggaattttccatactcataagcttgttgctggatggcttgcagggattgatggcttatagttgactccactttgactcagctggtagaaactctgctatatggtgagaaattgggtgtcagggcgattgtaataagctgcacacagagcgc

SEQ ID NO: 263 - DNA, 1110 bp, Artificial Sequence
  Description of Artificial Sequence: Synthetic polynucleotide
tgtgttgcccaggctggtctcaaactcctgggctcaagcagtcctcccgccttggcctcccaaagtgctgggattacaggcatgagccaccacgcctggcttaggtttactcttcactgcttgggatcaggtgatttagtttcatgattcctgtagccatctttcaaagggcatgtgagaatagccgggccactagggatagtaggtagtctgtttctctttctctactggggaaggaatttggaatactgagatttgttcatatctgagcatgttagcttcagattttccttgttgccaaattaatggcagttttgaaagctgagtgagctaccttaataagtcctgtgtgtcctgctgctggaagtggaggccctgttcttattgcagcatggtaatttgttgacagtgctgtggtgacagtgctttctggagggagttgaatagaaggttgagtccaatgcttacagtgagctcttagctctcagtagcagacatctgccacttgctgagctgcaccctgggctaggtgctgtcccagagacctcatctgcattctctcctccagctctcctggcaactctgtgagagaattcatgtcctgattcccatttgatagaaatgggaacacacagatgtatgaggtaacttggatggccatgtagctttgaaatgagaattaaagccacaatttcaactgaggtttccctgagttgggagcattcactcttacccctgtgctgtacttctttgcattttcacagaaacctctctttagatttctgcagggtggcaggttgcatgaggaagctctggaggtctcagttgattgtgagctcccatgggcctcctgtaaaagggcagccaaacaagcatggcctcgggctgatttaggggaagtgcaggatgcagaggccaggaggaagtcctctagacactgtttctttgcccaactttgccctggacacctgctctgtgccaggccaggtgctgacaccaccactgggagcagctggagacggcccccctgtctctgtgacgcatctcctggttaggacctattctggaccccacatctcacctgcaacacatcagctgcacacagagcgc

SEQ ID NO: 264 - DNA, 1083 bp, Artificial Sequence
  Description of Artificial Sequence: Synthetic polynucleotide
taatcaccagaaaatcaattttggaaaagattattgtgtgtgtgtgtgtgtgtgtgtgtgtgtgtgagagagagagagagagagagagagagaagatcttgctctgttgcccaggctggagtgcagtggcacagtatagctcacagcagcctcgaactcccaggctcaagagatcctcttgaagttcagccacatggtcagcccttttgagtaaagctgacctctccagaacatgtgttgttggaggaattagggggaagctgtgggtatggggctggggtccaggagagcaatgcctctgaaccaataatgttgttgccaaatgttgcaatgcaggagccacttctttcaagtggttttaaaaatcaccagtatctagtaatatttaaatgtaattttaagcaaaataattattagaaaaattcatatgttctatgatttcaaggcattgaagaaataaaatgtatagagagaatttgtaagaaaccatgtcaaaatttaatattattcatgacctgagtggtgagatgagtgacttttatgtcattttatacaatatagaacatttcaaattactatgtatgtatgataccttgaaaatcaatcagaagccataaaaggtttaaaaaataggacaagttaaaaatctaaaatatatacattaatgtcttgcttttcttaccgttttctgattcacactgacaactttaaaccctatttataagctgatgaatctcaactgggatacagtctttgaactccagacctatatatacaaccaccaatctagcatcttaatttagatagttaataggcatctgacatgctacaaatgcaaaactgagcttctgacttttgctaaataaagttcataaagtcttgcccttctttgctaatggttgctgtagccaaaatattggaatgacttttatttttacactttactcatatttcttatgcagtccatcagcaaatatttatggctctgctttcaaaatacaatttgaatatttaaactccacatcactctcactgctatcatgagttattgtctagcctcccaatgagctgcacacagagcgc

SEQ ID NO: 265 - DNA, 1063 bp, Artificial Sequence
  Description of Artificial Sequence: Synthetic polynucleotide
gctgcacacagagcgcccaaatatttgtagcactaagaaactggtcttgaagaataggaaatggtgctaatagagtagcagaattaggtaaagcccacttacctggtgatgctctcactttagggagaaccagaaagtgccaatgattacttaatatgtagccgtatggcaaagttttaagtaattttgattccttttctggatcagtaatttatatctggttgtcccaatttagatgtgagaatctggactgaaatgcatgtagtaaatattaactgatcatatataattaagcagataataccagtccacttattagcacctcagaaaaaaataaaccactatacaaatttgaactgtcattattttaagaaaaacttgagtaaacatgcaaaaacaagaaagctggtagcaatcaacatggctaggacctgcacagtaattttacttttttgccttcagttcataaccttgttaggtctttgctttgtggaggatgctatttctcatgcattaactcttaagtgcttacacataactaaagttttattaaaagaataatgaaatagtatacttacatcaattttccttctacacatatagcagtattattattgatgcttttaatcatccattcctgtagctgaactacctaatcaagtataaaacaaagaacatatttcctgtattacttgcagcacaagcattacaaaattaacttacattaaaagaaaaaacttgtctaagtaatccaaatattccttagtgtcatcgatgtaagattcacattctattctaaatagcaataggtaaaattcttgtatacaatgaaacagaaaagaaaagactgaattcaggttgtattgcatttgttctacaatcaagaagcaattatacttcaaatactctatcaccaaatctcaactggtggggacaaaaatcatgtaaaatcccaaggtacagattaaaacaccaagtcctgcaaaaagcccagtaacttggagtgaaaaggagttagctatgttttgtccttaaaaaattaagagttttttttttttttttt

SEQ ID NO: 266 - DNA, 1031 bp, Artificial Sequence
  Description of Artificial Sequence: Synthetic polynucleotide
aaaaatccaaaaattagctcgtatggtggtgcgtgcctgtagtctcagctactcagggggctgaagtgggaggatcactggagccccagaggttgaggctgcagtgagctgagattgcaccagcacactccagcatgagtgaccctctatcaaaaaaaaagaaaaaaggaaaaaaaaagtcacaagagagtaatataataaggaggaggggaaagatcctatgtccatagagaaaagaatggaaaagcgatcagtaagccagaccgaaagatgggtgggttttggatagtctggaatccctggatgatgaggtgtctttgaggaatgcacatttacagtttggctgcagaatggggtataagaagattaattgtggctggaaaagaacatcggtgaatacggagaatggtgatggcccggcagaagagttgctggtgtggcatggcctatagaggcactgtggtagagtggaaagagatagtattctggctctgcttattagctgggtgaccttggtcatgaagttctgtggctctttgctttatatatctatacagtagagataggatgcttcgcagaattaagattatgatgaagagagaaagcctaggtgatacaggcacacatgtatttcactctcaatacaaaaagaacaacaaaaacgttgttttgttttgtagaacagagcttttgagcaaaagaatgatgtcactattgctttgaaacagttgtttctgatagattggggggtagtgaaggccctagggtaattgccccataacaagagtggctgtaagagtccaggtaattcagtcaaagtctgaactagaccagtgcctgtaggatttgaaataaggagctgaatgggggaagcattgcaaacacgaagtcaacatgttcagaatgttctgagcaagggaagtggtattgctagggataacagtggtttcataaatggaaataggtttggcattgctgctgcttttgattatggagtaacataaaattgaggttggctgcacacagagcgc

SEQ ID NO: 267 - DNA, 1012 bp, Artificial Sequence
  Description of Artificial Sequence: Synthetic polynucleotide
acatttgggtgacttgctttagtgctctattaaatttattgtggtggtatgaaacctgtaatgtctctgagatatgcctccatattaattttaaaatagacacgaagtaatcctcaacatttagaacatttattttggactgatgcttggttattaagctaaaataagtcaagtaattcactttattaaattataaaaattattaaatctactatttgtttaagtttccattacaaatttgtgtgcttcatgtttgaagttgtatgataatctatttatatgatatagcagagaggaaaataaaggcataatgtttatttttaattgaatttgttcttagtcatttgtatcaataaagtaagaagatttccaacaacttaatgtgtttctattagtcataaaaagtatcactatactaatgtatagtcatcagtcctcaattattttctggacataggctcagctcttcatgtgaaggtcattattatattcctatatgatggttgaaatgatcagtgacttctgcgtaatagatgtcatgtttttatgcaccttcattcatctgcctaattttatatctcctcctctaatatattttcatttgcttgtttttcttatttttcagtgtactttaaattatatggccttataaagagtcccttataaaaccatcagatctcattagaactcactcactatcacaagaacaacatgaggaaaactgcccctatgatccaattacctttacctgtcctttccttgacacttagggattacgaggattttaattcaagatgaggtttgggtggggacacaaaacctaccatatcagtagacattatgttagtttctttgaatactatgaataagctgtaaatagataataaaagtttctcaatgtgctttccaacagtcagtaaacaagagaattttgtaaatagtatacaattttatatcactgcattcttgaggaatctgatactgaataaacctttagctgcacacagagcgc

SEQ ID NO: 268 - DNA, 949 bp, Artificial Sequence
  Description of Artificial Sequence: Synthetic polynucleotide
tgggagactgaggcagaaggatcacttgagcccaggagtttgagaccagactgggcaatatggcaaaactctgtctctaccagaaatacaaaaattaacggggcatgatggtacatccctgtagtctcagctgctcagaaggctgatgtgggaggactgcttgagccctgaaaatggaagttgcagtgagctgagatctcaccactgtactccaggcaacacaacaagaccttgtctcaaacaaaaataataataattctgacaggatctgattgaaagaggaatcacagtggttctaacacttgtgatccatccagacatgtttatgtgctttgttaaaacaacatcctgaaagaagtgttgtaatggacttccatgcttaggaaaagaagtgctataatttgcttccatactcaggtgggttttgttctgcctggagagtcatcctacatgagctatttctttaaatcaagatgctaaacagtaaaaggacctgttaataataatttaatccatttatatcaagtttactaaacaattaccttgaaaaacacatatataaacatacccatatgtgtatatatacatactccaaaatagtataatggtgcaggttcagatatatactttgtattcactagcgaattcgagaaaacagaattggtatgggttggctgtgtccacatccaaatctcatcttgaattgtatctcccagaattcccacatgttgtggatgggacctagtgggaggtgattgaatcattgttgccggtttttctcatgctattctcatgatagtgaataagtctcacaagatctaatgggtttatcaggggtttccacttttgcttcttcctctttctctgttgctgctgccatgtaagaagtgtcttttcgccctctgccatgattatgagacctccccagccattgctgcacacagagcgc

SEQ ID NO: 269 - DNA, 892 bp, Artificial Sequence
  Description of Artificial Sequence: Synthetic polynucleotide
gctgcacacagagcgcctcttggactcattggaagacctactgttttaatttttgctgctgataaaactgcatcacagagaggttacctaatttgcccaaggtcacaggacaggactagtaagtggtcttggttcattattgtcaaatttactaatcaccttgagaaaaattaagattggatggttgccttattttacaacttagaagatgattgaagacattttggtgcaggtggggagccagattgcaagtagctcagtgagttgtgtgggtgagttaagcaaccttttttattctttttttttgagacggagttttgctgttggtgcccaggctagagtgcagtcacagcttactgaaacctccacctcctcatttcaagcgattcacctgaactcctgaccttaggtgatctgcccgcatcagcctccccaaggtgctgggattacaggcgtgagccaccatgcccagctgagttaagcaatctttatgtagagctctcctttgagaaagaagttggttggttcaaagaaagataaatgggacagtggcttggaagaggtaatggaggctaggaaggtgtttatcaacaaaggaagatgtaggctgggcgcagtggctcacacctataatccccacactttgggaggctgagatgggaggattacttgagcctaggagtttaagaccagtctgggcaacatagggtgacccctgtctccacaaaaaattaaaaaaattagccaggcgtggtggcatgtgcctgtggtcccagctacgaggggctgaggtgggaggattgcttgagcctgggaggtcgaggctgcaatgagccataattgtgccactgcactccagcttgggtgacagagtgagaccctgtctcaaaaa

SEQ ID NO: 270 - DNA, 878 bp, Artificial Sequence
  Description of Artificial Sequence: Synthetic polynucleotide
cctgacctcatgatccgcctgccttggcctcccaaagtgctaggactacaggcgtgagctactacacccggctgggccttcatggttattaaatgtaaatacaacggggccaagctcagtggctcatacctgtaatcccagcactttgggaggccaaggcaagcagatcatttgagtccaggagttcaagaccagcctgagcaacatagtgaaaccccgtctcgaccagaaaatacaaaaattagccaggtagtccctgctacagggctgaggtgggaggattgcttgagcctgggaggtcgcggctgcagtgggccaagatggcaccattgcactccagcctgggtgacagagcaacaccctgtataccgtatacaactgcttagatatgtacatgattagtgacaagagggatcctcccttggtaatagaaaatttgggctaggcatgctgcatcccaaactgatgaaccgaaactgctacaaatggtctctaccaacacattcccacggctaagtacgaagaacaagggcgaatggtcagaattaagctcaaacctagctgaagcactcaacattgattcattccttggaccaattacttgctaaatctctatgaactggtatcttatttgtacaatgaggttgctattttaaaaattaatgttaccagctgggcccagtggctcaggcctgtaaacccagcactttgggagcccaaggcaggtggatcgcttcaggtcagttccagaccagcttagccaacatggtgaaaccccgtctctactaaaatacaaaaaaaatttagctgggtatggtggcaggtgcctgtaatcccagctactcaggaggctggggcagtagctgcacacagagcgc

SEQ ID NO: 271 - DNA, 865 bp, Artificial Sequence
  Description of Artificial Sequence: Synthetic polynucleotide
gttggccaggctggtcttgaactcctgacctcaggtgatctgcctgcctcggcctcccaaagtgctgggattacaggcatgagccaccgtgcctggcctgtcaatttacagttttcacaggtagtgtatgagagttccgcttgatctacatcttcaccaccagttgctgttttcagtcactgattgattgatttatgcattttattgtagtttaaatttgcaattccctgatgacaaattacgttttgtacttttttaaaactgttaatgttcacttacgtgtccttgttttaaagtccctaacaggtcttttgtccacttttaatcatgtgactaggtttttcttatagactccaggaattatatattctgcatatgaatcctttatgaaataagtgaattgcaattattttctcttactcagtggttcccattttcattcccttaatgctgtcttttaatgaatacttttgttttaatgtaaaccaacttatcaatcttttcctttgtggttagtgggggatgtgtggtgtgtttgtgtatgtgtgtgtgtttgtgtgtgtgtgtgtgtgtgtgtgtttcttctgaatacttctaagattttctctgttttctgctttagcggttttcctaaagtgtgcctagatcttttactttgaatttattctgcttgggtttcataagacttcttgaatatgtgcctcaatgccttttaattatttttgaaaatgattggtcagtactacataaaatcttgcttctgctgattctgctcttctcttttggaatatatatatatatatatatatgtatgaatttctattcttatctgtattttccatacttttagctgcacacagagcgc

SEQ ID NO: 272 - DNA, 853 bp, Artificial Sequence
  Description of Artificial Sequence: Synthetic polynucleotide
gctgcacacagagcgcaggctaaaatggcagagttgcagagttgtgataaagaaatataggctgggcatggtggctcacgcctataatcccagcactttggaaggccgaggcgggcagatcacctgaggtcaggagctcgagaccagcctggccaacatgacaaaaccccgtctttactaaaaatacaaaaattagcagggcatggtggcaggctcctgtaatcccagctacttgggaggctgaggcaggagaatagcttgaacctgggaggtgggggttgcagtgagccgagatcacgccactgcattccagcctgggtgacagagtgatactccatctcaaaaagtatggccgcgaaactcaaaatatttactgcctggacttctttcagaaaaagtttgccaaccctcgatctagcagatcaaatactataaaatacaccttttgaaacaggctttctggggaaaaaacaaaacaggttatttccaacaaatgattattgagcacctgagtgtaagtgttgtcctgtgaatttcaggaaataaacagatgcatctttaataatcctgcccttaagaaaattacagcccagcaggaaaaaaaaaatcagaaaagaagataaacaattttaaagtgtcaaagctcaaaaagccacccaaaatcttaactttctaaaaacgtggcccaaatctcagtaattataatgataagaagattaaaagcaagagaagttcaataactgagctgaagtcacacagccaggtagagaggcagggcttgaatccctatctttgtttcttccttgcatactacaccatttgatttaatcattttatttgttcaacatttacc

SEQ ID NO: 273 - DNA, 832 bp, Artificial Sequence
  Description of Artificial Sequence: Synthetic polynucleotide
gctgcacacagagcgccctttttaaaaaatgttttattaatgttgtttaagtttctcattgtgttcttgtattatttttctgatttcattaagttgtttatgtcctgttgtagctcactgagcttccttagaacaattaccttgaattctttgtcatccaatttatgtatttcaatttattttgaaataataattcaaaacatttatgcacctaattacacagactcaaaatgtatacaacaaaaacggacagaaattaaaggagaaatacacatttatagttggaatgatcaacactgctttcccagtgattcataaaataagtaaatggaaaattagtaaaaatataaatgacttgaaaaccactatcaactagacttccctcaatgacatttataaaacaccttactcacgagggacagaatacatgttcttttcaagcatatattctagaccataaaacacatttttacacatttaaaaattaaaaccatacaaagtatgttttctaaccacaatggtattaaatgagaaataagcaacagaaagatgtacggaagatctccaaattttaaaaaactaaatagcatacttcttagtcaccataatcaaagaagaaatcaaaagataatgtagagaatatttgaactaaatgaaagtgaacatatactaaaatttgcaggatgctgatagagcagtacttacaggaaaatttatagcattaaagaaaggtctcaaattaataacctaactttccattttaagaaactggaagaagctaggtgcagtcttgcatgcctataatctcagctactcaggaggctcaggaagg

SEQ ID NO: 274 - DNA, 804 bp, Artificial Sequence
  Description of Artificial Sequence: Synthetic polynucleotide
gctgcacacagagcgcctgtcattttttgacattttaataattgcccttctgactggagtgaggtggtatctcattgtggtttttatttgaatttctctaatgaccagtgatgttgagcttttcttttcatatgcttgttggctgcatgtatgtcttcttttgaaaagtatctgttcatgtcctttgcctactaatgtatttttaaagcagtagtaaaaactaatgaaaatattaacagtaaattctcttagaaaagataaaataccatgttgtagtctgctagttgtccttgaagctcttttatctcaacagctaaagtctcagccctgaaagcataaaataaatacattcataaatatgtacataaaaatatacataagaaaatgaacattacaaacaatatggatagctacaaagttagtattataagcacaaaatactgaatgaatactgaatacttattactcacctcttttcatatgacaaatatactgaattctcttgattgtacatttctattcccttctgaagtttattaacttcagttgtaagttcacttattttacttctattagaaaagaaataagaatgtcagcaatacttttaatccagaaaactctagttaagcaaaatttaaactttccattaatacgtaataataatataaatagttttgtgaaattcactaaaagaatgcagaaagtttaggtggcttatttcattaagaatgaggtatattctggctgggtgcggtgggtcaagcctgtaatcccaacactttgggaggccgaggcaggcgcatc

SEQ ID NO: 275 - DNA, 779 bp, Artificial Sequence
  Description of Artificial Sequence: Synthetic polynucleotide
ggattaccaatgtgggccaccatgccccactaccatcaggtttttaaatttttaattttgaaataattatagatttacaggccattacaaagaaagtacagagaagtcccctgtacccttaatttagttccccccaatggctgcatgttatataactatagtacaatatcaaacccaagaatctgacattggtacattgtttgtatatagttctaggtcattttatcatgtgtagatttgtgtaactatcactggaaaccagaaaaaaaagtttcatcacaacaaagatttccctgcgggtgccaccacttaattagttacactcacttcccatggcacccaccccaccacaactactaatatgttctttttttttttgagacagtgtcactctgttgcccaggctggagtgcagtggcgcaacctcagctcactgcaacctctgcctcctgggttcaagcaattcccttgcctcagcctctcagtagctgggattacaggtgtgcaccaccacgcctggctaatttttgtatattttagtagagatggggttttgccatgttggccagtctggtcttgaactccttacctcaggtgatctgcctgcttcagcctcccaaaatgctgggattacaggcgtgagccaccacacctggcctcaccttcatttttgaaagatatttttgctgggtatagaattctaaatggacagagtttttttctttcattcattttaagatactgctccactttcttctcactagctgcacacagagcgc

SEQ ID NO: 276 - DNA, 722 bp, Artificial Sequence
  Description of Artificial Sequence: Synthetic polynucleotide
gctgcacacagagcgcctcttggctctgccagctcctagcttggtgaacactggcaagttatatcatccctcagagcctcaatttgctcatctgcataaaaggtgtatgaaaaagaactgtaaatttctcacaataactcccacagattattagaaattaataaactcaaatatgaaatgtcgctagcatcaatgtgtgctaaataatgctaactcctctccatcccaacttacccactcctttaaaaaacaaaagcaaggtttctttgcagggacttttagaattcagggtcagaatataaatttcaagtcccaaagtgggcaaataaatcctggaacccaatggaagaatgtgtttctacatatattatttctgttatgtataatgggtgaatcatatctacaaaatatattttacatataattacaaaatgtatgaatctccttaatactcagactttataacttaatactttcataaaatctgtctaggcatgccttaatttatataagaagcagcattcctaaattcatttattaaagatttttttttcttttttcttttttttactttaagttgtgggatacatgtgcagaacgtgcaggtttgttacatagggatacatgtgccactgtggtttgctgcacctatcaacccatcatctaggttttaagccctgcatgcattaggtatttgtcctaatgctatccttccccttgcc

SEQ ID NO: 277 - DNA, 638 bp, Artificial Sequence
  Description of Artificial Sequence: Synthetic polynucleotide
catcacaaagcagtttctgagaattcttctgtctagtttgtaagtgactatatcccgtttaccacgaattcctcaaagagctgcaaatatccacaagcagattctacaaaagaagtgttaaactgctctatcaaaagaaaggttcagctctgtgaattgaacgcacacatcaccaaggagtttctgagaatgcttctgtctagtttttatgtgaagatatttctttttccaccataggaaacaaagcactccaagtgaacacttatagattctacaaaaagtttgtttcaacactgctctatcaaggaaagtttcaagtctgtgagttgaatgcacacattacaaagaactctctgagaatgcttgggtctacttttatgtgaagataccctttgccaaccaattcctcaaagagttccaaatatccacacgcatatcctacaaaagctgtgtttcaatactgttgtttcaaaagacagattcaactctgttacttaaatgcacgcttctcagtgaagttcctgagaatgcttctgtccagtttttatgtgaagatacttgcctttccaccataggcaaaaaatggctccaaatgaacagttgcagatctcacaaaaagacagctgcacacagagcgc

SEQ ID NO: 278 - DNA, 12 bp, Unknown
  Description of Unknown: Motif sequence
  modified_base (7)..(8): a, c, t, g, unknown or other
actacanntccc

SEQ ID NO: 279 - DNA, 14 bp, Artificial Sequence
  Description of Artificial Sequence: Synthetic oligonucleotide
gcgctctgtgtgct

SEQ ID NO: 280 - DNA, 41 bp, Artificial Sequence
  Description of Artificial Sequence: Synthetic oligonucleotide
cctgcaataatggccatgaggcaggcggatcacgaggtcag

SEQ ID NO: 281 - DNA, 49 bp, Artificial Sequence
  Description of Artificial Sequence: Synthetic oligonucleotide
cctggcttctagagttttctttctcttctcaggcgcccacagatgagat

SEQ ID NO: 282 - DNA, 290 bp, Artificial Sequence
  Description of Artificial Sequence: Synthetic polynucleotide
acccggccttggacacgccattttcaactccgtggtgcgttttttttttttttttttttttttgtaatggagttttgctcttgttgcccaggatggagtgcaagggatcttggctcaccacagcctctgcctcctgggttcaagtgattcttctgcctcagcctcccaagtagctgggattataagcacccaccaccacgcccagctaattttgtattttttagaagagatggagtttctccagttggccaggatggtctgtatatcctgacctcatgatctgcccacca

What is claimed is:

1. A pharmaceutical composition comprising a nucleic acid construct, a cargo covalently attached to the nucleic acid construct, and a pharmaceutically-acceptable excipient, wherein:
   (a) the cargo is a therapeutic cargo or diagnostic cargo;
   (b) the nucleic acid construct comprises a first deoxyribonucleic acid sequence that induces cell type-preferential uptake of the nucleic acid construct by a cell from a pre-selected tissue, wherein the first deoxyribonucleic acid sequence comprises at least 70% sequence identity to the nucleic acid sequence set forth in:
      (i) SEQ ID NO: 282;
      (ii) SEQ ID NO: 209;
      (iii) SEQ ID NO: 268;
      (iv) SEQ ID NO: 277;
      (v) SEQ ID NO: 203;
      (vi) SEQ ID NO: 211;
      (vii) SEQ ID NO: 216;
      (viii) SEQ ID NO: 230;
      (ix) SEQ ID NO: 241; or
      (x) SEQ ID NO: 251; and
   (c) the pharmaceutical composition is formulated for administration to a subject.

2. The pharmaceutical composition of claim 1, wherein the cell from the pre-selected tissue is a white blood cell.

3. The pharmaceutical composition of claim 1, wherein the cell from the pre-selected tissue is a pancreatic cell.

4. The pharmaceutical composition of claim 1, wherein the cell from the pre-selected tissue is a lung cell.

5. The pharmaceutical composition of claim 1, wherein the first deoxyribonucleic acid sequence has at least 90% sequence identity to the nucleic acid sequence set forth in:
   (i) SEQ ID NO: 282;
   (ii) SEQ ID NO: 209;
   (iii) SEQ ID NO: 268;
   (iv) SEQ ID NO: 277;
   (v) SEQ ID NO: 203;
   (vi) SEQ ID NO: 211;
   (vii) SEQ ID NO: 216;
   (viii) SEQ ID NO: 230;
   (ix) SEQ ID NO: 241; or
   (x) SEQ ID NO: 251.

6. The pharmaceutical composition of claim 1, wherein the nucleic acid construct further comprises a promoter and a nucleic acid sequence that encodes a peptide or protein, wherein the promoter drives expression of the nucleic acid sequence that encodes the peptide or protein.

7. The pharmaceutical composition of claim 1, wherein the nucleic acid construct further comprises a second deoxyribonucleic acid sequence that directs genomic integration of a region of the nucleic acid construct upon internalization of the nucleic acid construct by the cell from the pre-selected tissue.

8. The pharmaceutical composition of claim 6, wherein the peptide or the protein is a tumor suppressor or a peptide or protein that induces cancer cell death.

9. The pharmaceutical composition of claim 6, wherein the peptide or protein is a multiple myeloma tumor suppressor.

10. The pharmaceutical composition of claim 6, wherein the peptide or protein is an antigenic protein, wherein the antigenic protein is translated specifically in the cell from the pre-selected tissue upon administration of the pharmaceutical composition to the subject.

11. The pharmaceutical composition of claim 1, wherein the cargo is a cytotoxic agent.

12. The pharmaceutical composition of claim 11, wherein the cargo is a therapeutic drug.

13. The pharmaceutical composition of claim 11, wherein the cargo is a radiotherapeutic agent.

14. The pharmaceutical composition of claim 1, wherein the cell from a pre-selected tissue is a hematologic cancer cell.

15. The pharmaceutical composition of claim 1, wherein the cell from a pre-selected tissue is a multiple myeloma cell.

16. The pharmaceutical composition of claim 1, wherein the cell from a pre-selected tissue is a pancreatic cancer cell.

17. The pharmaceutical composition of claim 1, wherein the cargo is an anti-cancer drug.

18. The pharmaceutical composition of claim 1, wherein the cargo is a detectable label or moiety for tracking or visualization of distribution of the nucleic acid construct.

19. The pharmaceutical composition of claim 1, wherein the first deoxyribonucleic acid sequence comprises at least 90% sequence identity to the nucleic acid sequence set forth in SEQ ID NO: 282.

20. The pharmaceutical composition of claim 1, wherein the first deoxyribonucleic acid sequence comprises at least 95% sequence identity to the nucleic acid sequence set forth in SEQ ID NO: 282.

21. The pharmaceutical composition of claim 1, wherein the first deoxyribonucleic acid sequence comprises at least 98% sequence identity to the nucleic acid sequence set forth in SEQ ID NO: 282.

* * * * *